United States Patent
Venkitasubramanian et al.

(10) Patent No.: US 10,480,018 B2
(45) Date of Patent: Nov. 19, 2019

(54) GENUS OF EPIMERASE ENZYMES FOR CONVERSION OF FRUCTOSE TO ALLULOSE AT HIGH TEMPERATURE AND LOW PH

(71) Applicant: Archer Daniels Midland Company, Decatur, IL (US)

(72) Inventors: Padmesh Venkitasubramanian, Forsyth, IL (US); William Schroeder, Champaign, IL (US); Mark Welch, Fremont, CA (US); Sridhar Govindarajan, Los Altos, CA (US)

(73) Assignee: ARCHER DANIELS MIDLAND COMPANY, Decatur, IL (US)

( * ) Notice: Subject to any disclaimer, the term of this patent is extended or adjusted under 35 U.S.C. 154(b) by 0 days.

(21) Appl. No.: 15/575,636

(22) PCT Filed: May 20, 2016

(86) PCT No.: PCT/US2016/033489
§ 371 (c)(1),
(2) Date: Nov. 20, 2017

(87) PCT Pub. No.: WO2016/191267
PCT Pub. Date: Dec. 1, 2016

(65) Prior Publication Data
US 2018/0112244 A1    Apr. 26, 2018

Related U.S. Application Data

(60) Provisional application No. 62/165,298, filed on May 22, 2015.

(51) Int. Cl.
C12P 19/24    (2006.01)
C12P 19/02    (2006.01)
C12N 9/90    (2006.01)

(52) U.S. Cl.
CPC ............. *C12P 19/24* (2013.01); *C12N 9/90* (2013.01); *C12P 19/02* (2013.01)

(58) Field of Classification Search
None
See application file for complete search history.

(56) References Cited

FOREIGN PATENT DOCUMENTS

| WO | 2014/049376 A1 | | 4/2014 |
| WO | WO2014049373 | * | 4/2014 |
| WO | 2015/032761 A1 | | 3/2015 |

OTHER PUBLICATIONS

Accession No. B9AYF5. Mar. 4, 2009.*
Accession No. B9AYF5. Mar. 4, 2009. Alignment to SEQ ID No. 20 (Year: 2009).*
Accession B9AYF5. Mar. 4, 2009. Alignment to SEQ ID No. 18 (Year: 2009).*
Accession B9AYF5. Mar. 4, 2009. Alignment to SEQ ID No. 16 (Year: 2009).*
Accession B9AYF5. Mar. 4, 2009. Alignment to SEQ ID No. 14 (Year: 2009).*
Chica et al. Curr Opin Biotechnol. Aug. 2005;16(4):378-84. (Year: 2005).*
Singh et al. Curr Protein Pept Sci. 2017, 18, 1-11 (Year: 2017).*
GenBank Accession No. WP_006396376.1, Sugar phosphate isomerase/epimerase [Delftia acidovorans], May 16, 2013.
GenBank Accession No. WP_006396376.1, Sugar phosphate isomerase/epimerase [Burkholderia multivorans], May 8, 2013.
Choi et al., "Improvements in the Thermostability of D-Psciose 3-Epimerase from Agrobacterium Tumiefaciens by Random and Site-Directed Mutagenesis", pp. 7316-7320, 2011, Applied and Environmental Microbiology (vol. 77, No. 20), American Society for Microbiology.

* cited by examiner

*Primary Examiner* — Christian L Fronda
(74) *Attorney, Agent, or Firm* — Andrew F. Nilles

(57) ABSTRACT

Disclosed herein are three geneses of proteins herein established to exhibit a fructose to allulose epimerase activity that are useful for production of allulose from fructose at high temperatures and at low pH in the range of 4.5 to 6.0. Two of the three geneses descend phylogenetically from a common ancestral protein defined herein, and these geneses are distinguished from each other by different parental descendant proteins also defined herein. The proteins with high levels of sequence identity to the parental nodes defining from these two geneses generally exhibit higher levels of specific fructose to glucose epimerase activity than prior known fructose to allulose epimerases and exhibit such activity at low pH. A third genus is not defined by phylogenetic origin except by not descending from the same ancestor as the first two geneses but generally exhibit similar levels of fructose to allulose epimerase activities as prior art epimerases described to be useful for fructose to allulose conversion.

4 Claims, 16 Drawing Sheets
Specification includes a Sequence Listing.

| DT3Ease or DP3Ease source / Properties | P. cichorii | A. tumefaciens | Arthrobacter Globiformis | Clostridium cellulolyticum | Clostridium scindens | Ruminococcus sp. | Desmospora sp. | Clostridium sp. | Clostridium bolteae | Rhizobium leguminosarum | R. sphaeroides des |
|---|---|---|---|---|---|---|---|---|---|---|---|
| Optimum temperature (T°C) | 60 | 50 | 70 | 55 | 60 | 60 | 60 | 65 | 55 | 60 | 40 |
| Optimum pH | 7 | 8 | NR | 7 | 7.5 | 7.5 | 7.5 | 8 | 7 | 8 | 9 |
| Metal dependence | no | yes | yes | NR | yes | yes | yes | yes | yes | yes | yes |
| Optimal metal ion | *$Mn^{+2}$ | $Mn^{+2}$ | $Mg^{+2}$ | no | $Mn^{+2}$ | $Mn^{+2}$ | $Co^{+2}$ | $Co^{+2}$ | $Co^{+2}$ | $Mn^{+2}$ | $Mn^{+2}$ |
| Half life (Min, 50° C) |  | 63.5 | NR | >120 | 180 | >240 | 120 | 180 | 156 @ 55C | NR | ~60 |
| Optimum substrate | Tagatose | Allulose | Allulose | Allulose | Allulose | Allulose | Allulose | Allulose | Allulose | Allulose | Fructose |
| $K_{cat}$ (min$^{-1}$) (allulose) | NR | 2381 | NR | 3243 | 1827 | 2427 | 5157.8 | 32185 | 2940 | NR | NR |
| $K_{cat}$ (min$^{-1}$) (fructose) | NR | 2068 | NR | 3354 | 350 | 3562 | 63573 | 16372 | 3540 | NR | NR |
| $K_m$ (mM) (D-allulose) | NR | 12 | 30.1 | 17.4 | 28.3 | 48 | 81.3 | 227.6 | 27.4 | NR | NR |
| $K_m$ (mM D-Fructose) | NR | 24 | 31.5 | 53.5 | 40.1 | 216 | 549 | 279 | 59.8 | NR | NR |
| $K_m$ (mM D-tagatose) | 55 | 762 | NR | NR | NR | NR | NR | NR | NR | NR | NR |
| $K_{cat}/K_M$ (mM$^{-1}$ min$^{-1}$ allulose) | NR | 205 | NR | 186 | 64.5 | 51 | 327 | 141.4 | 107 | NR | NR |
| $K_{cat}/K_M$ (mM$^{-1}$ min$^{-1}$ fructose) | NR | 85 | NR | 62.7 | 8.72 | 16 | 116 | 58.7 | 59 | NR | NR |
| Equilibrium ratio (fructose:allulose, T°C) | 80:20 30°C | 68:32 30°C | 76:24 30°C | 68:32 55°C | 72:28 50°C | 72:28 60°C | 70:30 60°C | 72:28 65°C | 68:32 60°C | 75:25 45°C | 77:23 40°C |

Fig. 2

| SEQ ID No: | Node 7 | Node 8 | Node 9 | Node 10 | Node 11 | Node 12 | SEQ ID NO: 166 | SEQ ID NO: 168 | SEQ ID NO: 170 |
|---|---|---|---|---|---|---|---|---|---|
| 26 | 98.7 | 88.6 | 82.8 | 79.8 | 72.4 | 72.7 | 47.1 | 25 | 27 |
| 28 | 97.3 | 88.2 | 82.8 | 79.8 | 72.1 | 72.1 | 47.1 | 24.3 | 27 |
| 30 | 99.3 | 89.2 | 83.5 | 80.5 | 73.1 | 73.4 | 47.1 | 24.7 | 27 |
| 32 | 99.3 | 89.2 | 83.5 | 80.5 | 73.1 | 73.4 | 47.4 | 24.7 | 27 |
| 34 | 99.7 | 89.6 | 83.8 | 80.8 | 73.4 | 73.7 | 47.1 | 24.7 | 27 |
| 36 | 81.8 | 91.6 | 85.5 | 79.8 | 71.4 | 69 | 45 | 24 | 26.3 |
| 38 | 68.4 | 75.1 | 80.8 | 75.8 | 65.7 | 63.6 | 42.6 | 24.3 | 24.2 |
| 40 | 69 | 76.4 | 82.2 | 76.4 | 66.3 | 64 | 43.4 | 24 | 25.3 |
| 42 | 63.8 | 66.9 | 71 | 76.1 | 65.5 | 63.5 | 45.7 | 24.9 | 27.3 |
| 44 | 63.1 | 66.2 | 70.3 | 74.7 | 64.8 | 62.5 | 45.3 | 24.9 | 26.6 |
| 46 | 63.1 | 66.2 | 68.9 | 72.7 | 64.2 | 61.4 | 45 | 24.2 | 27 |
| 48 | 63.4 | 65.9 | 70 | 75.1 | 65.2 | 62.8 | 45.3 | 23.9 | 26.3 |
| 50 | 56.8 | 58.9 | 60.3 | 62.7 | 71.9 | 67.8 | 49.5 | 22.6 | 24.9 |
| 52 | 40.7 | 40.1 | 42.1 | 44.4 | 48.8 | 48.5 | 41.9 | 24.3 | 23.2 |
| 54 | 40.7 | 40.1 | 42.1 | 44.4 | 48.8 | 48.5 | 41.9 | 24.3 | 22.8 |

Fig. 12

| SEQ ID No | Node 1 | Node 2 | Node 3 | Node 4 | Node 5 | Node 6 | Node 12 | SEQ ID NO: 166 | SEQ ID NO: 168 | SEQ ID NO: 170 |
|---|---|---|---|---|---|---|---|---|---|---|
| 84 | 56.7 | 58.8 | 58.8 | 59.9 | 68.2 | 68.9 | 56.8 | 49.5 | 25.2 | 25.6 |
| 86 | 51.7 | 52.8 | 53.8 | 54.2 | 60.4 | 61.1 | 54.4 | 45.8 | 23.3 | 23.6 |
| 88 | 59.6 | 61.9 | 62.3 | 62.6 | 68.2 | 68.9 | 55.3 | 46.4 | 25.9 | 24.6 |
| 90 | 57.4 | 59.5 | 59.2 | 59.2 | 66.4 | 67.5 | 57.6 | 47.1 | 28.7 | 28.2 |
| 92 | 57.4 | 59.5 | 59.2 | 59.2 | 64.4 | 67.5 | 57.2 | 47.1 | 26 | 25.6 |
| 94 | 60.6 | 63.7 | 62.6 | 65.1 | 72 | 75.8 | 63.8 | 49.8 | 27.6 | 24.6 |
| 96 | 57.1 | 60.6 | 61.6 | 62.6 | 68.2 | 64 | 55 | 46.4 | 27.7 | 23.9 |
| 98 | 58.1 | 61.9 | 64 | 65.7 | 73 | 69.6 | 57.6 | 46 | 26.9 | 24.2 |
| 100 | 57.1 | 58.5 | 59.5 | 61.2 | 68.2 | 65.4 | 56.8 | 50.5 | 26.4 | 25.3 |
| 102 | 57.8 | 58.8 | 60.2 | 61.9 | 68.5 | 66.1 | 56.8 | 50.5 | 25.3 | 23.5 |
| 104 | 65.7 | 69.6 | 72.7 | 76.8 | 69.2 | 65.4 | 55.3 | 45.3 | 25.8 | 23.5 |
| 106 | 72.7 | 79 | 82.4 | 79.9 | 73.4 | 69.9 | 59.1 | 48.8 | 26.1 | 25.3 |
| 108 | 73 | 79.9 | 82.7 | 79.6 | 72.3 | 68.9 | 58.1 | 49.1 | 25.4 | 25.3 |
| 110 | 73 | 80.6 | 83 | 79.9 | 72.7 | 69.6 | 58.4 | 50.2 | 25.8 | 26 |
| 112 | 74.7 | 82.7 | 86.2 | 82.7 | 73 | 68.9 | 56.4 | 49.1 | 27.1 | 24.9 |
| 114 | 70.9 | 77.2 | 80.3 | 77.5 | 70.2 | 67.1 | 54.6 | 46.7 | 26.5 | 25.3 |
| 116 | 74.7 | 81 | 84.8 | 81.3 | 72.3 | 68.9 | 55 | 49.5 | 26.1 | 28 |
| 118 | 74.4 | 80.6 | 84.4 | 81 | 72 | 68.5 | 54.6 | 49.1 | 25.8 | 27.7 |
| 120 | 78.2 | 87.5 | 83.4 | 79.2 | 71.6 | 69.9 | 55.9 | 49.8 | 28.5 | 24.9 |
| 122 | 99.7 | 88.2 | 89.8 | 81.7 | 75.4 | 74 | 59.9 | 48.1 | 28.4 | 25.6 |
| 124 | 99.3 | 88.6 | 84.8 | 81.7 | 74.7 | 73.4 | 58.8 | 48.1 | 28.4 | 25.6 |
| 126 | 99 | 88.6 | 84.8 | 81.7 | 74.7 | 73.4 | 58.8 | 48.1 | 28.7 | 25.3 |
| 128 | 98.3 | 87.9 | 84.4 | 81.7 | 75.4 | 74 | 59.9 | 48.1 | 28.7 | 26.3 |
| 130 | 99.3 | 87.9 | 84.4 | 81.7 | 75.4 | 74 | 59.9 | 47.8 | 29.1 | 25.6 |
| 132 | 98.6 | 87.2 | 83.7 | 81 | 74.7 | 73.4 | 59.2 | 47.4 | 28.7 | 25.6 |
| 134 | 99 | 87.5 | 84.1 | 81.3 | 74.4 | 73 | 58.8 | 47.4 | 28.7 | 25.6 |

Fig. 13

| Clone # | Database Annotation | SEQ ID NO: nucleic acid | SEQ ID NO: amino acid |
|---|---|---|---|
| 204015 | 657330520 epimerase [Delftia sp. 670] | 121 | 122 |
| 203963 | 657014434 MULTISPECIES: epimerase [Microbacterium] | 63 | 64 |
| 203954 | 670521153 epimerase [Scisionella sp. SE31] | 99 | 100 |
| 203949 | 357939788 xylose isomerase [Burkholderia sp. YI23] | 115 | 116 |
| 204020 | 221170077 xylose isomerase [Burkholderia multivorans CGD1] | 33 | 34 |
| 204024 | 547313834 putative uncharacterized protein [Roseburia sp. CAG_18] | 135 | 136 |
| 203991 | 545707803 xylose isomerase [Galdieria sulphuraria] | 51 | 52 |
| 203999 | gi|507517694|ref|YP_008039310.1| xylose isomerase [Burkholderia sp. RPE64] | 137 | 138 |
| 203973 | 655586162 epimerase [Pseudonocardia spinosispora] | 185 | 186 |
| 203974 | 647563593 epimerase [Asaia platycodi] | 47 | 48 |
| 203979 | 647123017 dolichol monophosphate mannose synthase [Clostridiales bacterium VE202-26] | 139 | 140 |
| 203945 | 364562616 AP endonuclease, family 2 [Flavonifractor plautii ATCC 29863] | 141 | 142 |
| 204036 | 563571586 epimerase [Mesorhizobium sp. LNHC221B00] | 189 | 190 |
| 204012 | 167665225 AP endonuclease, family 2 [Anaerotruncus colihominis DSM 17241] | 143 | 144 |
| 203971 | 497956672 dolichol monophosphate mannose synthase [Paenibacillus senegalensis] | 145 | 146 |
| 203983 | 158441905 hypothetical protein CLOBOL_00069 [[Clostridium] bolteae ATCC BAA-613] | 147 | 148 |
| 203969 | 297155197 xylose isomerase domain-containing protein [Streptomyces bingchenggensis BCW-1] | 83 | 84 |
| 204034 | 516501546 hypothetical protein [Candidatus Caldatribacteirum californiense] | 149 | 150 |
| 204035 | 647122997 hypothetical protein [[Clostridium] scindens] | 151 | 152 |
| 203956 | 399124962 Chain A, D-Psicose 3-Epimerase Clostridium Cellulolyticum H10 | 153 | 154 |
| 203977 | 359352371 sugar phosphate isomerase/epimerase [Sphaerochaeta pleomorpha str. Grapes] | 155 | 156 |
| 203964 | 696665502 hypothetical protein [Blautia producta] | 157 | 158 |
| 203970 | 225037368 AP endonuclease, family 2 [Blautia hydrogenotrophica DSM 10507] | 159 | 160 |
| 203987 | 145848056 AP endonuclease, family 2 [Ruminococcus torques ATCC 27756] | 161 | 162 |
| 203984 | 394755878 AP endonuclease, family 2 [Clostridium sp. MSTE9] | 163 | 164 |

Fig. 16

| SEQ ID #: | Source | Node 1 | Node 2 | Node 3 | Node 4 | Node 5 | Node 6 | Node 7 | Node 8 | Node 9 | Node 10 | Node 11 | Node 12 |
|---|---|---|---|---|---|---|---|---|---|---|---|---|---|
| SEQ ID NO: 166 | *Arthrobacter globiforms* | 48.1 | 50.5 | 49.8 | 49.8 | 53.6 | 56.1 | 46.7 | 46.4 | 47.4 | 49.8 | 52.9 | 54.7 |
| SEQ ID NO: 168 | *Bulkholderia RP64* | 28.4 | 27 | 27 | 27.3 | 30.1 | 29.8 | 24.7 | 24.3 | 25.3 | 25.3 | 28 | 28.7 |
| SEQ ID NO: 170 | *Desmospora sp.8437* | 25.6 | 24.9 | 24.9 | 23.9 | 25.6 | 24.9 | 27 | 27.3 | 27.3 | 27.7 | 27.7 | 28 |
| SEQ ID NO: 172 | *Agrobacterium tumefaciens* | 26 | 27.7 | 27.7 | 27.3 | 26.6 | 26.6 | 27.3 | 28.4 | 28.7 | 29.8 | 29.8 | 29.8 |
| SEQ ID NO: 174 | *Agrobacterium tumefaciens* | 26 | 27.3 | 27.7 | 27 | 26.6 | 26.6 | 26.6 | 27.7 | 28 | 28.7 | 29.1 | 29.1 |
| SEQ ID NO: 176 | *P. cichorii* | 28.4 | 26.6 | 26.3 | 26.6 | 29.4 | 29.1 | 24.8 | 24.8 | 25.9 | 26.9 | 29 | 29.7 |
| SEQ ID NO: 178 | *Clostridium cellulolyticum* | 23.5 | 23.9 | 24.2 | 24.2 | 24.2 | 24.9 | 24.9 | 27.6 | 28 | 28.7 | 28 | 28 |
| SEQ ID NO: 180 | *Clostridium cellulolyticum* | 23.2 | 23.5 | 23.9 | 23.9 | 23.9 | 24.6 | 24.6 | 27.3 | 27.6 | 28.3 | 27.6 | 27.6 |

Fig. 17

GENUS OF EPIMERASE ENZYMES FOR CONVERSION OF FRUCTOSE TO ALLULOSE AT HIGH TEMPERATURE AND LOW PH

CROSS REFERENCE TO RELATED APPLICATION[S]

This application is a national stage entry of International Application No. PCT/US2016/033489, filed May 20, 2016, which itself claims priority to U.S. provisional application No. 62/165,298 entitled "A Genus of Epimerase Enzymes for Conversion of Fructose to Allulose at High Temperature and Low pH" filed May 22, 2015, each of which is incorporated herein by reference in its entirety.

BACKGROUND OF THE INVENTION

D-Allulose is the C-3 epimer of D-fructose and is a low-caloric sweetener. Allulose, also widely known as D-psicose, is very similar to glucose in regards to intensity and sweetness. However, because the body metabolizes allulose differently than most sugars, such as glucose and fructose, its caloric value is significantly lower. In fact, its caloric value is nearly zero. Like glucose, D-allulose has about 70% of the relative sweetness of sucrose but only provides 0.2 kcal/mol energy.

The bio-conversion of D-fructose to D-allulose by D-tagatose-3-epimerase (DT3E) or by D-psicose-3-epimerase (FIG. 1) has long been recognized, however, different enzymes having the required activity have different properties such as pH and cofactor requirements, equilibrium constants, temperature tolerance and the like. For commercial production of D-allulose it is desirable to discover or engineer enzymes with robust and advantageous properties. The conversion of D-fructose to D-allulose will diversify the traditional sweetener product portfolio associated with corn processing by adding a natural low caloric sweetener and bulking agent to the traditional portfolio of sweeteners derived from corn starch, i.e. corn syrup, high fructose corn syrup (HFCS), glucose and fructose.

Most of the epimerases that have been identified to date are of bacterial origin being principally derived from soil bacteria exemplified by *Pseudomonas* sp., *Agrobacterium* sp., *Rhizobium* sp., *Clostridium* sp., *Desmospora* sp., *Rhodobactor* sp., and *Arthobactor* sp. Most of these epimerases show dependence on manganese and/or cobalt as a cofactor and are inactive in absence of these metals. Notable exceptions are the epimerase from *P. chicorii* and *A. globiformis* which show activity in the presence of $Mg^{+2}$. The use of $Mg^{+2}$ as a metal cofactor instead of $Mn^{+2}$ or $Co^{+2}$ provides a significant advantage when deploying these enzymes in commercial production, which helps in process integration with existing fructose production operations and avoids issues related to waste water treatment.

FIG. 2 is a table that list various properties for several known epimerases suggested for use in allulose production. The optimal pH range for these epimerases is between 7.0 and 9.0 with the majority being between 7.0 and 8.0. The optimum temperature ranges between 40° C. and 70° C. with the great majority being in the range of 55-60° C. In order to have the best catalytic efficiency the reaction should be operated as close to the optimum pH and temperature as is practical. For commercial production, it is desirable to use higher temperatures of 60° C. or greater which allow a higher dissolved solids content for the input and output streams. However, fructose and allulose are subject to degradation at optimal operational pH's and temperatures. At a temperature of 60° C. fructose and allulose stability is best between pH 4.5 and 5.5. Operating the process at a pH of 7-8 and at such high temperatures results in formation of byproducts in the reaction mixture that leads to yield loss and requires removal of color bodies from the final product.

Therefore, there is a need in the art to discover new classes of epimerases that can convert fructose to allulose at low pH and high temperatures which can do so at a high dissolved solids content using $Mg^{+2}$ as a metal cofactor. There is also a need to provide recombinant DNA expression systems for efficient expression of such epimerases from bacterial sources.

SUMMARY OF THE INVENTION

The present disclosure describes a method of producing allulose comprising, contacting a solution containing fructose with an enzyme having at least 64.2% sequence identity to SEQ ID NO: 22 for a time and under conditions suitable to convert at least a portion of the fructose to allulose. An exemplary embodiment of the invention is where the enzyme is encoded by one of the following: SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, and SEQ ID NO: 54.

Certain embodiments include a method wherein the enzyme has at least 72.7% sequence identity to SEQ ID NO: 20. Preferred embodiments include a method wherein the enzyme has at least 80.8% sequence identity to SEQ ID NO: 18. Exemplary embodiments include a method wherein the enzyme has at least 88.2% sequence identity to SEQ ID NO: 16. Most exemplary embodiments include a method wherein the enzyme has at least 97.3% sequence identity to SEQ ID NO: 14.

A preferred embodiment includes a method wherein the enzyme is obtained from a microorganism containing a recombinant nucleic acid vector operably configured with a promoter to express a nucleic acid sequence encoding the protein having at least 64.2% sequence identity to SEQ ID NO: 22 wherein the promoter is non-native to the nucleic acid encoding said protein, wherein the microorganism is selected from the group consisting of *Bacillus licheniformis, Saccharomyces cerevisiae, Schizosaccharomyces ombe, Pseudomonas putida, Pichia* sp. *Aspergillus* sp., *Trichoderma reesei, Corynebacterium glutamicum, E. coli* and *B. subtilis*, more preferably *E. coli* and *B. subtilis*.

An additional aspect of the invention is a recombinant nucleic acid sequence operably configured with a promoter to express a nucleic acid sequence encoding the protein having at least 64.2% sequence identity to SEQ ID NO: 22 wherein the promoter is non-native to the nucleic acid encoding the protein, in a microorganism. Another aspect of the invention is a microorganism transformed with the recombinant nucleic acid sequence is selected from the group consisting of *Bacillus licheniformis, Saccharomyces cerevisiae, Schizosaccharomyces ombe, Pseudomonas putida, Pichia* sp. *Aspergillus* sp., *Trichoderma reesei, Corynebacterium glutamicum, E. coli* and *B. subtilis*, most preferably *E. coli* and *B. subtilis*.

An additional aspect of the invention is a solid matrix containing an enzyme having at least 64.2% sequence identity to SEQ ID NO: 22 immobilized thereon. A further aspect is a column containing the solid matrix and configured to receive an input flow of a solution containing fructose over the solid matrix and permit exit of an output flow of a solution containing fructose and allulose.

Another aspect of the invention is a method of producing allulose comprising, contacting a solution containing fructose with an enzyme having at least 61.1% sequence identity to SEQ ID NO: 12 for a time and under conditions suitable to convert at least a portion of the fructose to allulose. An exemplary embodiment of the invention is wherein the enzyme is encoded by one of the following: SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, and SEQ ID NO: 134.

Certain embodiments of the invention include a method wherein the enzyme has at least 68.2% sequence identity to SEQ ID NO: 10. Another embodiment is a method wherein the enzyme has at least 76.8% sequence identity to SEQ ID NO: 8. Other embodiments include a method wherein the enzyme has at least 80.3% sequence identity to SEQ ID NO: 6. A preferred embodiment is a method wherein the enzyme has at least 87.2% sequence identity to SEQ ID NO: 4. Another preferably embodiment is a method wherein the enzyme has at least 98.6% sequence identity to SEQ ID NO: 2.

An additional embodiment of the invention is a method wherein the enzyme is obtained from a microorganism containing a recombinant nucleic acid vector operably configured with a promoter to express a nucleic acid sequence encoding the protein having at least 61.1% sequence identity to SEQ ID NO: 12 wherein the promoter is non-native to the nucleic acid encoding said protein, wherein the microorganism is selected from the group consisting of *Bacillus licheniformis, Saccharomyces cerevisiae, Schizosaccharomyces ombe, Pseudomonas putida, Pichia* sp. *Aspergillus* sp., *Trichoderma reesei, Corynebacterium glutamicum, E. coli* and *B. subtilis*, most preferably *E. coli* and *B. subtilis*.

An additional aspect of the invention is a recombinant nucleic acid sequence operably configured with a promoter to express a nucleic acid sequence encoding the protein having at least 61.1% sequence identity to SEQ ID NO: 12 wherein the promoter is non-native to the nucleic acid encoding said protein, in a microorganism. A further embodiment includes a microorganism transformed with the recombinant nucleic acid sequence selected from the group consisting of *Bacillus licheniformis, Saccharomyces cerevisiae, Schizosaccharomyces ombe, Pseudomonas putida, Pichia* sp. *Aspergillus* sp., *Trichoderma reesei, Corynebacterium glutamicum, E. coli* and *B. subtilis*, more preferably is *E. coli* and *B. subtilis*.

Another aspect is a solid matrix containing an enzyme having at least 61.1% sequence identity to SEQ ID NO: 12 immobilized thereon. An additional aspect is a column containing the solid matrix and is configured to receive an input flow of a solution containing fructose over the solid matrix and permit exit of an output flow of a solution containing fructose and allulose.

Additional aspects of the invention include performing the methods described herein wherein the conversion of fructose to allulose is done at a temperature of at least 50° C., more preferably at a temperature of 70° C. Exemplary embodiments include performing these methods wherein the conversion of fructose to allulose is done at pH 5.0. Additional embodiments include performing the methods described herein where the fructose solution is selected from the group consisting of solubilized crystalline fructose and high fructose corn syrup (HFCS), wherein the fructose solution has a dissolved solids content of at least 50% w/w.

Another aspect of the invention is a method of producing allulose comprising, contacting a solution containing fructose with an enzyme having an amino acid sequence selected from the group consisting of SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, and SEQ ID NO: 164 for a time and under conditions suitable to convert at least a portion of the fructose to allulose. Certain embodiments include a method wherein the conversion of fructose to allulose is done at a temperature of at least 50° C. and a pH of 6.0, more preferably wherein the conversion of fructose to allulose is done at a temperature of at least 60° C. and a pH of 6.0, and most preferred wherein the conversion of fructose to allulose is done at a temperature of at least 70° C. and a pH of 5.0.

Exemplary embodiments include a method wherein the enzyme having the amino acid sequence selected from the group consisting of SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, and SEQ ID NO: 164 is obtained from a microorganism containing a recombinant nucleic acid vector operably configured with a promoter to express a nucleic acid sequence encoding the protein having an amino acid sequence selected from the group consisting of SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, and SEQ ID NO: 164 wherein said promoter is non-native to the nucleic acid encoding said protein and the microorganism is selected from the group consisting of *Bacillus licheniformis, Saccharomyces cerevisiae, Schizosaccharomyces ombe, Pseudomonas putida, Pichia* sp. *Aspergillus* sp., *Trichoderma reesei, Corynebacterium glutamicum, E. coli* and *B. subtilis*, more preferably *E. coli* and *B. subtilis*.

An additional aspect is a recombinant nucleic acid sequence operably configured with a promoter to express a nucleic acid encoding an amino acid sequence selected from the group consisting of SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, and SEQ ID NO: 164 wherein the promoter is non-native to the nucleic acid encoding said protein, in a microorganism, wherein the microorganism is selected from the group consisting of *Bacillus licheniformis, Saccharomyces cerevisiae, Schizosaccharomyces ombe, Pseudomonas putida, Pichia* sp. *Aspergillus* sp., *Trichoderma reesei, Corynebacterium glutamicum, E. coli* and *B. subtilis*, most preferably *E. coli* and *B. subtilis*.

A further aspect of the invention is a solid matrix containing an enzyme having an amino acid sequence selected from the group consisting of SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, and SEQ ID NO: 164 immobilized thereon. An additional aspect is a column containing the solid matrix and is configured to receive an input flow of a solution containing fructose over the solid matrix and permit exit of an output flow of a solution containing fructose and allulose.

BRIEF DESCRIPTION OF THE DRAWINGS

FIG. 2 depicts a table of comparisons of D-psicose-3-epimerase and D-Tagatose-3-epimerase from prior art microorganisms. It is noted that $Mn^{+2}$ in listed to be the optimal ion for obtaining the crystalline structure of the epimerase enzyme from P. cichorii, however the P. cichorii epimerase enzyme does show activity in the presence of $Mg^{+2}$.

FIG. 12 depicts the percent amino acid identities that each of the proteins from the Node 11 area in FIG. 11 have with each of the predicted ancestral proteins for the depicted sub nodes.

FIG. 13 depicts the percent amino acid identities that each of the proteins from the Node 6 area in FIG. 11 have with each of the predicted ancestral sequences for the depicted sub nodes.

FIG. 16 depicts a reference table of SEQ ID NO's for the 25 selected proteins showing FA epimerase activity in FIG. 4. The odd SEQ ID is the nucleotide sequence and the even SEQ ID is the amino acid sequence.

FIG. 17 depicts the percent identities that each of the ancestral nodes share with several sequences known to have FA epimerase activity in the art.

Figure 1:
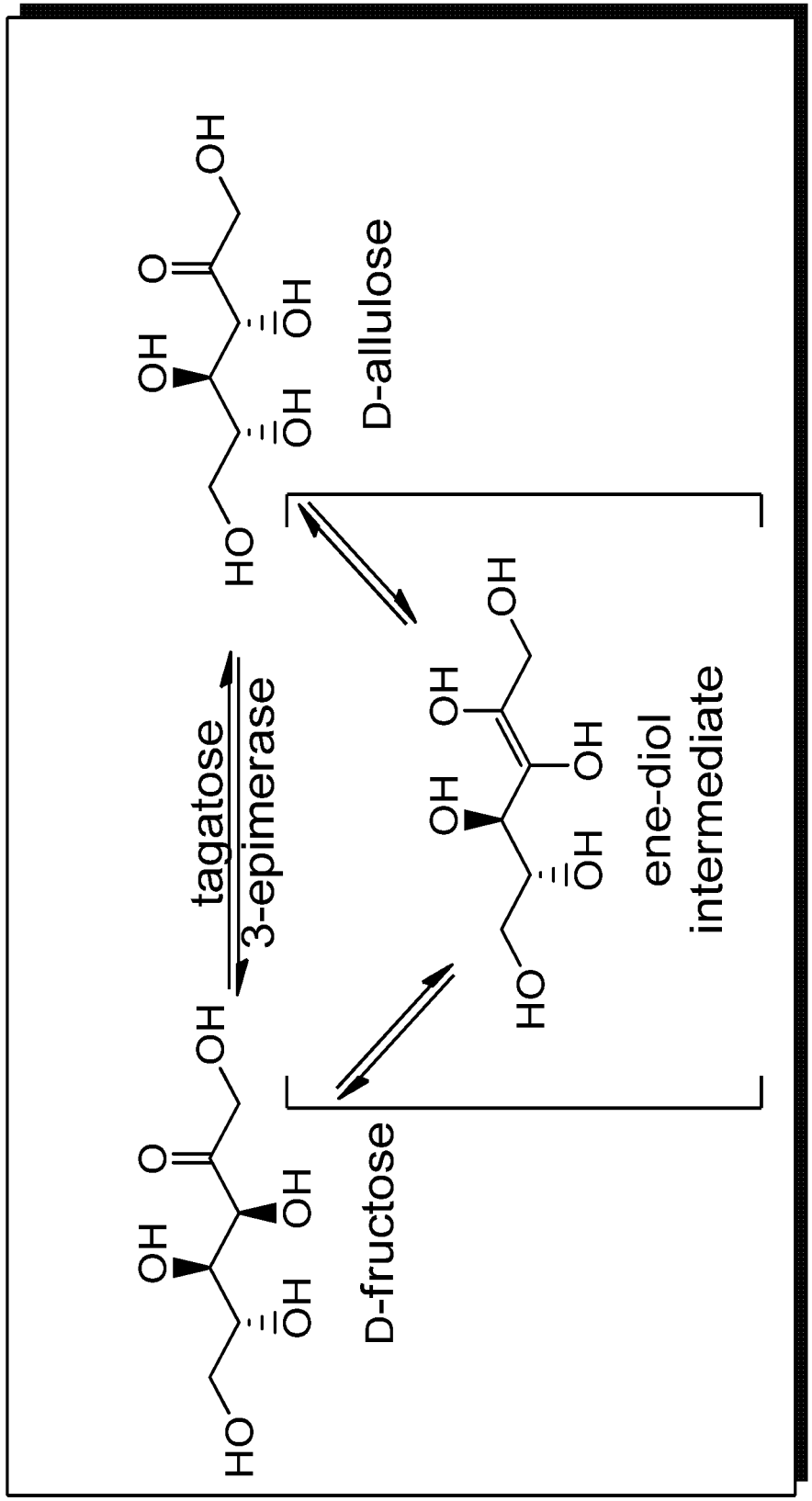
FIG. 1 depicts the bioconversion of D-fructose to D-allulose.

BRIEF DESCRIPTION OF SEQ ID LISTING (Please note that all odd numbered SEQ ID's are nucleotide sequences and all even numbered SEQ ID's are the protein sequences encoded by the previous nucleotide sequence, except for SEQ ID NO:181 and 182 which are both nucleotide sequences)

SEQ ID NO: 1 is an exemplary nucleotide sequence encoding a hypothetical protein for ancestral Node 1 (>211288_1).

SEQ ID NO: 2 is the protein sequence encoded by SEQ ID NO: 1.

SEQ ID NO: 3 is an exemplary nucleotide sequence encoding a hypothetical protein for ancestral Node 2 (>211289_2).

SEQ ID NO: 4 is the protein sequence encoded by SEQ ID NO: 3.

SEQ ID NO: 5 is an exemplary nucleotide sequence encoding a hypothetical protein for ancestral Node 3 (>211290_3).

SEQ ID NO: 6 is the protein sequence encoded by SEQ ID NO: 5.

SEQ ID NO: 7 is an exemplary nucleotide sequence encoding a hypothetical protein for ancestral (>211291_4).

SEQ ID NO: 8 is the protein sequence encoded by SEQ ID NO: 7.

SEQ ID NO: 9 is an exemplary nucleotide sequence encoding a hypothetical protein for ancestral Node 5 (>211292_5).

SEQ ID NO: 10 is the protein sequence encoded by SEQ ID NO: 9.

SEQ ID NO: 11 is an exemplary nucleotide sequence encoding a hypothetical protein for ancestral Node 6 (>211293_6).

SEQ ID NO: 12 is the protein sequence encoded by SEQ ID NO: 11.

SEQ ID NO: 13 is an exemplary nucleotide sequence encoding a hypothetical protein for ancestral Node 7 (>ancestor155_7).

SEQ ID NO: 14 is the protein sequence encoded by SEQ ID NO: 13.

SEQ ID NO: 15 is an exemplary nucleotide sequence encoding a hypothetical protein for ancestral Node 8 (>ancestor179_8).

SEQ ID NO: 16 is the protein sequence encoded by SEQ ID NO: 15.

SEQ ID NO: 17 is an exemplary nucleotide sequence encoding a hypothetical protein for ancestral Node 9 (>ancestor186_9).

SEQ ID NO: 18 is the protein sequence encoded by SEQ ID NO: 17.

SEQ ID NO: 19 is an exemplary nucleotide sequence encoding a hypothetical protein for ancestral Node 10 (>ancestor196_10).

SEQ ID NO: 20 is the protein sequence encoded by SEQ ID NO: 19.

SEQ ID NO: 21 is an exemplary nucleotide sequence encoding a hypothetical protein for ancestral Node 11 (>ancestor204_11).

SEQ ID NO: 22 is the protein sequence encoded by SEQ ID NO: 21.

SEQ ID NO: 23 is an exemplary nucleotide sequence encoding a hypothetical protein for ancestral Node 12 (>ancestor202_12).

SEQ ID NO: 24 is the protein sequence encoded by SEQ ID NO: 23.

SEQ ID NO: 25 is a nucleotide sequence encoding a protein originally annotated as a xylose isomerase domain protein TIM barrel from Burkholderia multivorans ATCC 17616 (>160344162).

SEQ ID NO: 26 is the protein sequence encoded by SEQ ID NO: 25.

SEQ ID NO: 27 is a nucleotide sequence encoding a protein originally annotated as an epimerase from *Burkholderia ubonensis* (>497775713).

SEQ ID NO: 28 is the protein sequence encoded by SEQ ID NO: 27.

SEQ ID NO: 29 is a nucleotide sequence encoding a protein originally annotated as a xylose isomerase-like TIM barrel family protein from *Burkholderia multivorans* (>685685795).

SEQ ID NO: 30 is the protein sequence encoded by SEQ ID NO: 29.

SEQ ID NO: 31 is a nucleotide sequence encoding a protein originally annotated as a xylose isomerase-like TIM barrel family protein from *Burkholderia multivorans* (>686811252).

SEQ ID NO: 32 is the protein sequence encoded by SEQ ID NO: 31.

SEQ ID NO: 33 is a nucleotide sequence encoding a protein originally annotated as a xylose isomerase domain protein TIM barrel from *Burkholderia multivorans* CGD1 (>221170077).

SEQ ID NO: 34 is the protein sequence encoded by SEQ ID NO: 33.

SEQ ID NO: 35 is a nucleotide sequence encoding a protein originally annotated as an epimerase from *Burkholderia acidipaludis* (>654281663).

SEQ ID NO: 36 is the protein sequence encoded by SEQ ID NO: 35.

SEQ ID NO: 37 is a nucleotide sequence encoding a protein originally annotated as a sugar phosphate isomerase/epimerase from *Rhizobium* sp. AP16 (>397725959).

SEQ ID NO: 38 is the protein sequence encoded by SEQ ID NO: 37.

SEQ ID NO: 39 is a nucleotide sequence encoding a protein originally annotated as an epimerase protein from *Agrobacterium radiobacter* K84 (>221727376).

SEQ ID NO: 40 is the protein sequence encoded by SEQ ID NO: 39.

SEQ ID NO: 41 is a nucleotide sequence encoding a protein originally annotated as an epimerase from *Asaia* sp. SF2.1 (>221727376).

SEQ ID NO: 42 is the protein sequence encoded by SEQ ID NO: 41.

SEQ ID NO: 43 is a nucleotide sequence encoding a protein originally annotated as an epimerase from *Asaia prunellae* (>647610741).

SEQ ID NO: 44 is the protein sequence encoded by SEQ ID NO: 43.

SEQ ID NO: 45 is a nucleotide sequence encoding a protein originally annotated as an epimerase from *Asaia astilbis* (>647535189).

SEQ ID NO: 46 is the protein sequence encoded by SEQ ID NO: 45.

SEQ ID NO: 47 is a nucleotide sequence encoding a protein originally annotated as an epimerase from *Asaia platycodi* (>647563593).

SEQ ID NO: 48 is the protein sequence encoded by SEQ ID NO: 47.

SEQ ID NO: 49 is a nucleotide sequence encoding a protein originally annotated as a hypothetical protein from SAR324 cluster bacterium SCGC AAA240-J09 (>518138525).

SEQ ID NO: 50 is the protein sequence encoded by SEQ ID NO: 49.

SEQ ID NO: 51 is a nucleotide sequence encoding a protein originally annotated as a xylose isomerase domain protein TIM barrel from *Galdieria sulphuraria* (>545707803).

SEQ ID NO: 52 is the protein sequence encoded by SEQ ID NO: 51.

SEQ ID NO: 53 is a nucleotide sequence encoding a protein originally annotated as a xylose isomerase domain protein TIM barrel from *Galdieria sulphuraria* (>545704633).

SEQ ID NO: 54 is the protein sequence encoded by SEQ ID NO: 53.

SEQ ID NO: 55 is a nucleotide sequence encoding a protein originally annotated as a predicted protein from *Micromonas* sp. RCC299 (>226520302).

SEQ ID NO: 56 is the protein sequence encoded by SEQ ID NO: 55.

SEQ ID NO: 57 is a nucleotide sequence encoding a protein originally annotated as a predicted protein from *Micromonas pusilla* CCMP 1545 (>226458054).

SEQ ID NO: 58 is the protein sequence encoded by SEQ ID NO: 57.

SEQ ID NO: 59 is a nucleotide sequence encoding a protein originally annotated as a xylose isomerase domain-containing protein from *Coccomyxa subellipsoidea* C-169 (>545368628).

SEQ ID NO: 60 is the protein sequence encoded by SEQ ID NO: 59.

SEQ ID NO: 61 is a nucleotide sequence encoding a protein originally annotated as a hypothetical protein from *Microbacterium maritypicum* (>544773573).

SEQ ID NO: 62 is the protein sequence encoded by SEQ ID NO: 61.

SEQ ID NO: 63 is a nucleotide sequence encoding a protein originally annotated as an epimerase from *Microbacterium* sp. (>657014434).

SEQ ID NO: 64 is the protein sequence encoded by SEQ ID NO: 63.

SEQ ID NO: 65 is a nucleotide sequence encoding a protein originally annotated as a hypothetical protein from *Microbacterium* sp. UCD-TDU (>516440582).

SEQ ID NO: 66 is the protein sequence encoded by SEQ ID NO: 65.

SEQ ID NO: 67 is a nucleotide sequence encoding a protein originally annotated as an epimerase from *Microbacterium paraoxydans* (>640680849).

SEQ ID NO: 68 is the protein sequence encoded by SEQ ID NO: 67.

SEQ ID NO: 69 is a nucleotide sequence encoding a protein originally annotated as a hypothetical protein from *Microbacterium barkeri* (>515770762).

SEQ ID NO: 70 is the protein sequence encoded by SEQ ID NO: 69.

SEQ ID NO: 71 is a nucleotide sequence encoding a protein originally annotated as an epimerase from *Microbacterium* sp. CH12i (>631270281).

SEQ ID NO: 72 is the protein sequence encoded by SEQ ID NO: 71.

SEQ ID NO: 73 is a nucleotide sequence encoding a protein originally annotated as an epimerase from *Geodermatophilaceae bacterium* URHB0062 (>652460722).

SEQ ID NO: 74 is the protein sequence encoded by SEQ ID NO: 73.

SEQ ID NO: 75 is a nucleotide sequence encoding a protein originally annotated as an epimerase from *Nakamurella lacteal* (>656113283).

SEQ ID NO: 76 is the protein sequence encoded by SEQ ID NO: 75.

SEQ ID NO: 77 is a nucleotide sequence encoding a protein originally annotated as an epimerase from *Microbacterium profundi* (>696574381).

SEQ ID NO: 78 is the protein sequence encoded by SEQ ID NO: 77.

SEQ ID NO: 79 is a nucleotide sequence encoding a protein originally annotated as an epimerase from *Corynebacterium*-like *bacterium* B27 (>665915735).

SEQ ID NO: 80 is the protein sequence encoded by SEQ ID NO: 79.

SEQ ID NO: 81 is a nucleotide sequence encoding a protein originally annotated as a hypothetical protein KILIM_053_00370 from *Kineosphaera limosa* NBRC 100340 (>403209571).

SEQ ID NO: 82 is the protein sequence encoded by SEQ ID NO: 81.

SEQ ID NO: 83 is a nucleotide sequence encoding a protein originally annotated as a xylose isomerase domain-containing protein from *Streptomyces bingchenggensis* BCW-1 (>297155197).

SEQ ID NO: 84 is the protein sequence encoded by SEQ ID NO: 83.

SEQ ID NO: 85 is a nucleotide sequence encoding a protein originally annotated as an epimerase from *Corynebacterium*-like *bacterium* B27 (>551277501).

SEQ ID NO: 86 is the protein sequence encoded by SEQ ID NO: 85.

SEQ ID NO: 87 is a nucleotide sequence encoding a protein originally annotated as an AP endonuclease family 2 from *Leifsonia aquatic* (>545651128).

SEQ ID NO: 88 is the protein sequence encoded by SEQ ID NO: 87.

SEQ ID NO: 89 is a nucleotide sequence encoding a protein originally annotated as an epimerase from *Phycicoccus jejuensis* (>663750742).

SEQ ID NO: 90 is the protein sequence encoded by SEQ ID NO: 89.

SEQ ID NO: 91 is a nucleotide sequence encoding a protein originally annotated as a xylose isomerase domain protein TIM barrel from *Tetrasphaera japonica* T1-X7 (>665504252).

SEQ ID NO: 92 is the protein sequence encoded by SEQ ID NO: 91.

SEQ ID NO: 93 is a nucleotide sequence encoding a protein originally annotated as a putative sugar phosphate isomerase/epimerase from *Streptomyces himastatinicus* ATCC 53653 (>302461117).

SEQ ID NO: 94 is the protein sequence encoded by SEQ ID NO: 93.

SEQ ID NO: 95 is a nucleotide sequence encoding a protein originally annotated as a hypothetical protein from *Pantoea* sp. A4 (>515917589).

SEQ ID NO: 96 is the protein sequence encoded by SEQ ID NO: 95.

SEQ ID NO: 97 is a nucleotide sequence encoding a protein originally annotated as an epimerase from *Burkholderia andropogonis* (>515917589).

SEQ ID NO: 98 is the protein sequence encoded by SEQ ID NO: 97.

SEQ ID NO: 99 is a nucleotide sequence encoding a protein originally annotated as an epimerase from *Sciscionella* sp. SE31 (>670521153).

SEQ ID NO: 100 is the protein sequence encoded by SEQ ID NO: 99.

SEQ ID NO: 101 is a nucleotide sequence encoding a protein originally annotated as a hypothetical protein from *Sciscionella marina* (>521986899).

SEQ ID NO: 102 is the protein sequence encoded by SEQ ID NO: 101.

SEQ ID NO: 103 is a nucleotide sequence encoding a protein originally annotated as a xylose isomerase domain protein TIM barrel from *Verminephrobacter eiseniae* EF01-2 (>121554852).

SEQ ID NO: 104 is the protein sequence encoded by SEQ ID NO: 103.

SEQ ID NO: 105 is a nucleotide sequence encoding a protein originally annotated as a D-tagatose 3-epimerase from *Burkholderia caribensis* MBA4 (>575864533).

SEQ ID NO: 106 is the protein sequence encoded by SEQ ID NO: 105.

SEQ ID NO: 107 is a nucleotide sequence encoding a protein originally annotated as a sugar phosphate isomerase/epimerase from *Burkholderia* sp. BT03 (>398072571).

SEQ ID NO: 108 is the protein sequence encoded by SEQ ID NO: 107.

SEQ ID NO: 109 is a nucleotide sequence encoding a protein originally annotated as a xylose isomerase domain-containing protein from *Burkholderia terrae* BS001 (>389938975).

SEQ ID NO: 110 is the protein sequence encoded by SEQ ID NO: 109.

SEQ ID NO: 111 is a nucleotide sequence encoding a protein originally annotated as an epimerase from *Burkholderia sordidicola* (>666644526).

SEQ ID NO: 112 is the protein sequence encoded by SEQ ID NO: 111.

SEQ ID NO: 113 is a nucleotide sequence encoding a protein originally annotated as a sugar phosphate isomerase/epimerase from *Burkholderia* sp. BT03 (>398057572).

SEQ ID NO: 114 is the protein sequence encoded by SEQ ID NO: 113.

SEQ ID NO: 115 is a nucleotide sequence encoding a protein originally annotated as a xylose isomerase domain-containing protein from *Burkholderia* sp. YI23 (>357939788).

SEQ ID NO: 116 is the protein sequence encoded by SEQ ID NO: 115.

SEQ ID NO: 117 is a nucleotide sequence encoding a protein originally annotated as a xylose isomerase domain-containing protein from *Burkholderia* sp. RPE67 (>636799039).

SEQ ID NO: 118 is the protein sequence encoded by SEQ ID NO: 117.

SEQ ID NO: 119 is a nucleotide sequence encoding a protein originally annotated as an epimerase from *Verminephrobacter aporrectodeae* (>497791920).

SEQ ID NO: 120 is the protein sequence encoded by SEQ ID NO: 119.

SEQ ID NO: 121 is a nucleotide sequence encoding a protein originally annotated as an epimerase from *Delftia* sp. 670 (>657330520).

SEQ ID NO: 122 is the protein sequence encoded by SEQ ID NO: 121.

SEQ ID NO: 123 is a nucleotide sequence encoding a protein originally annotated as a xylose isomerase domain-containing protein TIM barrel from *Delftia* sp. Cs1-4 (>333747546).

SEQ ID NO: 124 is the protein sequence encoded by SEQ ID NO: 123.

SEQ ID NO: 125 is a nucleotide sequence encoding a protein originally annotated as a hypothetical protein HMPREF9702_05076 from *Delftia acidovorans* CCUG 15835 (>512037489).

SEQ ID NO: 126 is the protein sequence encoded by SEQ ID NO: 125.

SEQ ID NO: 127 is a nucleotide sequence encoding a protein originally annotated as a xylose isomerase-like TIM barrel family protein from *Delftia acidovorans* (>673060237).

SEQ ID NO: 128 is the protein sequence encoded by SEQ ID NO: 127.

SEQ ID NO: 129 is a nucleotide sequence encoding a protein originally annotated as a xylose isomerase domain protein TIM barrel from *Delftia acidovorans* SPH-1 (>160361815).

SEQ ID NO: 130 is the protein sequence encoded by SEQ ID NO: 129.

SEQ ID NO: 131 is a nucleotide sequence encoding a protein originally annotated as a hypothetical protein HMPREF9701_05035 from *Delftia acidovorans* CCUG 274B (>512035962).

SEQ ID NO: 132 is the protein sequence encoded by SEQ ID NO: 131.

SEQ ID NO: 133 is a nucleotide sequence encoding a protein originally annotated as a xylose isomerase domain protein TIM barrel from *Delftia* sp. RIT313 (>612088518).

SEQ ID NO: 134 is the protein sequence encoded by SEQ ID NO: 133.

SEQ ID NO: 135 is a nucleotide sequence encoding a protein originally annotated as a putative uncharacterized protein from *Roseburia* sp. CAG_18 (547313834).

SEQ ID NO: 136 is the protein sequence encoded by SEQ ID NO: 135.

SEQ ID NO: 137 is a nucleotide sequence encoding a protein originally annotated as a xylose isomerase from *Burkholderia* sp. RPE64 (gi|507517694|ref|YP_008039310.1).

SEQ ID NO: 138 is the protein sequences encoded by SEQ ID NO: 137.

SEQ ID NO: 139 is a nucleotide sequence encoding a protein originally annotated as a dolichol monophosphate mannose synthase from *Clostridiales bacterium* VE202-26 (647123017).

SEQ ID NO: 140 is the protein sequence encoded by SEQ ID NO: 139.

SEQ ID NO: 141 is a nucleotide sequence encoding a protein originally annotated as an AP endonuclease, family 2 from *Flavonifractor plautii* ATCC 29863 (364562616).

SEQ ID NO: 142 is the protein sequence encoded by SEQ ID NO: 141.

SEQ ID NO: 143 is a nucleotide sequence encoding a protein originally annotated as a AP endonuclease, family 2 from *Anaerotruncus colihominis* DSM 17241 (167665225).

SEQ ID NO: 144 is the protein sequence encoded by SEQ ID NO: 143.

SEQ ID NO: 145 is a nucleotide sequence encoding a protein originally annotated as a dolichol monophosphate mannose synthase from *Paenibacillus senegalensis* (497956672).

SEQ ID NO: 146 is the protein sequence encoded by SEQ ID NO: 145.

SEQ ID NO: 147 is a nucleotide sequence encoding a protein originally annotated as a hypothetical protein CLOBOL_00069 from *Clostridium bolteae* ATCC BAA-613 (158441905).

SEQ ID NO: 148 is the protein sequence encoded by SEQ ID NO: 147.

SEQ ID NO: 149 is a nucleotide sequence encoding a protein originally annotated as a hypothetical protein from Candidatus *Caldatribacteirum californiense* (516501546).

SEQ ID NO: 150 is the protein sequence encoded by SEQ ID NO: 149.

SEQ ID NO: 151 is a nucleotide sequence encoding a protein originally annotated as a hypothetical protein from *Clostridium scindens* (647122997).

SEQ ID NO: 152 is the protein sequence encoded by SEQ ID NO: 151.

SEQ ID NO: 153 is a nucleotide sequence encoding a protein originally annotated as a chain A, D-Psicose 3-Epimerase from *Clostridium Cellulolyticum* H10 (399124962).

SEQ ID NO: 154 is the protein sequence encoded by SEQ ID NO: 153.

SEQ ID NO: 155 is the nucleotide sequence of sugar phosphate isomerase/epimerase from *Sphaerochaeta pleomorpha* str. Grapes (359352371).

SEQ ID NO: 156 is the protein sequence encoded by SEQ ID NO: 155.

SEQ ID NO: 157 is a nucleotide sequence encoding a protein originally annotated as a hypothetical protein from *Blautia* product (696665502).

SEQ ID NO: 158 is the protein sequence encoded by SEQ ID NO: 157.

SEQ ID NO: 159 is a nucleotide sequence encoding a protein originally annotated as an AP endonuclease, family 2 from *Blautia hydrogenotrophica* DSM 10507 (225037368).

SEQ ID NO: 160 is the protein sequence encoded by SEQ ID NO: 159.

SEQ ID NO: 161 is a nucleotide sequence encoding a protein originally annotated as an AP endonuclease, family 2 from *Ruminococcus torques* ATCC 27756 (145848056).

SEQ ID NO: 162 is the protein sequence encoded by SEQ ID NO: 161.

SEQ ID NO: 163 is a nucleotide sequence encoding a protein originally annotated as an AP endonuclease, family 2 from *Clostridium* sp. MSTE9 (394755878).

SEQ ID NO: 164 is the protein sequence encoded by SEQ ID NO: 163.

SEQ ID NO: 165 is a nucleotide sequence encoding the protein 3-keto epimerase from *Arthrobacter globiformis*.

SEQ ID NO: 166 is the protein sequence encoded by SEQ ID NO: 165.

SEQ ID NO: 167 is a nucleotide sequence encoding the epimerase enzyme derived from *Bulkholderia* RP64 as disclosed in PCT/US16/24217.

SEQ ID NO: 168 is the protein sequence encoded by SEQ ID NO: 167.

SEQ ID NO: 169 is a nucleotide sequence encoding the epimerase enzyme derived from *Desmospora* sp. 8437 which is codon optimized for expression in *E. coli*.

SEQ ID NO: 170 is the protein sequence encoded by SEQ ID NO: 169.

SEQ ID NO: 171 is a nucleotide sequence encoding the D-psicose epimerase derived from *Agrobacterium tumefaciens* as disclosed in U.S. Pat. No. 8,030,035

SEQ ID NO: 172 is the protein sequence encoded by SEQ ID NO: 171.

SEQ ID NO: 173 is a nucleotide sequence encoding the D-psicose epimerase derived from *Agrobacterium tumefaciens* as disclosed in U.S. Pat. No. 9,217,166.

SEQ ID NO: 174 is the protein sequence encoded by SEQ ID NO: 173.

SEQ ID NO: 175 is a nucleotide sequence encoding the epimerase enzyme derived from *P. cichorii*.

SEQ ID NO: 176 is the protein sequence encoded by SEQ ID NO: 175.

SEQ ID NO: 177 is a nucleotide sequence encoding the enzyme derived from *Clostridium cellulolyticum* as disclosed in WO2015/032761A1.

SEQ ID NO: 178 is the protein sequence encoded by SEQ ID NO: 177.

SEQ ID NO: 179 is a nucleotide sequence encoding an artificial variant of the epimerase enzyme derived from *Clostridium cellulolyticum* as disclosed in WO2015/032761A1.

SEQ ID NO: 180 is the protein sequence encoded by SEQ ID NO: 178.

SEQ ID NO: 181 is a nucleotide sequence encoding the epimerase enzyme derived from *P. cichorii* which has been codon optimized for expression in *E. coli*.

SEQ ID NO: 182 is a nucleotide sequence encoding the epimerase enzyme derived from *P. cichorii* which has been codon optimized for expression in *B. subtilis*.

SEQ ID NO: 183 is a nucleotide sequence encoding a protein originally annotated as an epimerase from *Amycolatopsis taiwanensis* (654476705).

SEQ ID NO: 184 is a protein sequence encoded by SEQ ID NO: 183.

SEQ ID NO: 185 is a nucleotide sequence encoding a protein originally annotated as an epimerase from *Pseudonocardia spinosispora* (655586162).

SEQ ID NO: 186 is a protein sequence encoded by SEQ ID NO: 185.

SEQ ID NO: 187 is a nucleotide sequence encoding a protein originally annotated as an epimerase from *Modestobacter* sp. KNN45-2b (692531537).

SEQ ID NO: 188 is a protein sequence encoded by SEQ ID NO: 187.

SEQ ID NO: 189 is a nucleotide sequence encoding a protein originally annotated as an epimerase from *Mesorhizobium* sp. LNHC221B00 (563571586).

SEQ ID NO: 190 is a protein sequence encoded by SEQ ID NO: 189.

DETAILED DESCRIPTION OF THE INVENTION

General Details

Disclosed herein are 3 families of epimerases that are effective at converting fructose to allulose that have not been previously identified as useful for this purpose. "FA epimerase" is used hereafter as a shorthand to mean an enzymatic activity that converts D-fructose to D-allulose such as exhibited by enzymes previously denoted in the art as D-tagatose-3-epimerase or D-psicose-3-epimerase. This definition is to distinguish from the general notation of "epimerase" such as shown in FIGS. 11 and 15-17 which merely reflects a notation found in databases of nucleic acid sequences and represents a computer generated best guess of an enzyme activity that might be exhibited by a protein encoded by a nucleic acid sequence in the database but which is not necessarily known to be an FA epimerase activity.

The three families of FA epimerases disclosed herein were discovered by mining databases of disclosed nucleic acid sequences to discover sequences that encode proteins having at least 30% amino acid sequence identity to the D-psicose-3-epimerase from *P. cichorii* (gi|2804234) SEQ ID NO:176. The data mining was performed by doing a BLAST search (http://blastncbi.nlm.nih.gov/Blast.cgi) on the Genbank non-redundant protein database. As disclosed in the background section hereof, *P. cichorii* is a known source for an FA epimerase which shows activity in the presence of Mg as the metal cofactor and shows a pH optimal of 7.0 which is among the lowest pH optima of prior known FA epimerases (see FIG. 2). Initial mining of nucleic acid sequences databases uncovered 660 sequences from as many different microorganism which were organized by phylogenetic relationship of the encoded protein sequences as depicted in FIG. 3.

In a first set of preliminary tests a synthetic DNA sequence encoding the *P. cichorii* FA epimerase designed to include codons that were optimized for expression of the encoded protein in *E. coli* (SEQ ID NO: 181) was cloned into an expression vector configured to express the nucleic acid sequence from a promoter operable in *E. coli*, and which contained sequences encoding a poly histidine tag to fuse to the N or C terminal of the encoded protein so the expressed protein could be readily isolated from a cell free extract from *E. coli* by binding to a nickel column. Initial tests by polyacrylamide gel electrophoresis verified that a protein of the anticipated size was expressed in *E. coli* and enzymatic assays demonstrated that crude extracts prepared from *E. coli* exhibited FA epimerase activity.

In a second set of preliminary tests, a synthetic DNA sequence designed to include codons that were optimized for expression of the *P. cichorii* enzyme in *B. subtilis* (SEQ ID NO: 182), was cloned and expressed from a vector containing a promoter configured to express proteins in *B. subtilis* with and without a histidine tag. Extracts of *B. subtilis* were prepared and polyacrylamide gel electrophoresis was used to establish production of a protein of the correct size with and without the histidine tag. *B. subtilis* cells containing the synthetic DNA sequence expressed without a histidine tag were grown in medium lacking $Mn^{+2}$ and $Co^{+2}$ and extracts were prepared and assayed for FA epimerase enzymatic activity in an assay buffer that included $Mg^{+2}$. These control tests indicated that *B. subtilis* is at least as suitable as *E. coli* for expressing the *P. cichorii* FA epimerase and would be an appropriate host for expressing and screening other candidate sequences for FA epimerase activity in the presence of $Mg^{+2}$ and absence of $Mn^{+2}$ and $Co^{+2}$.

Figure 3:
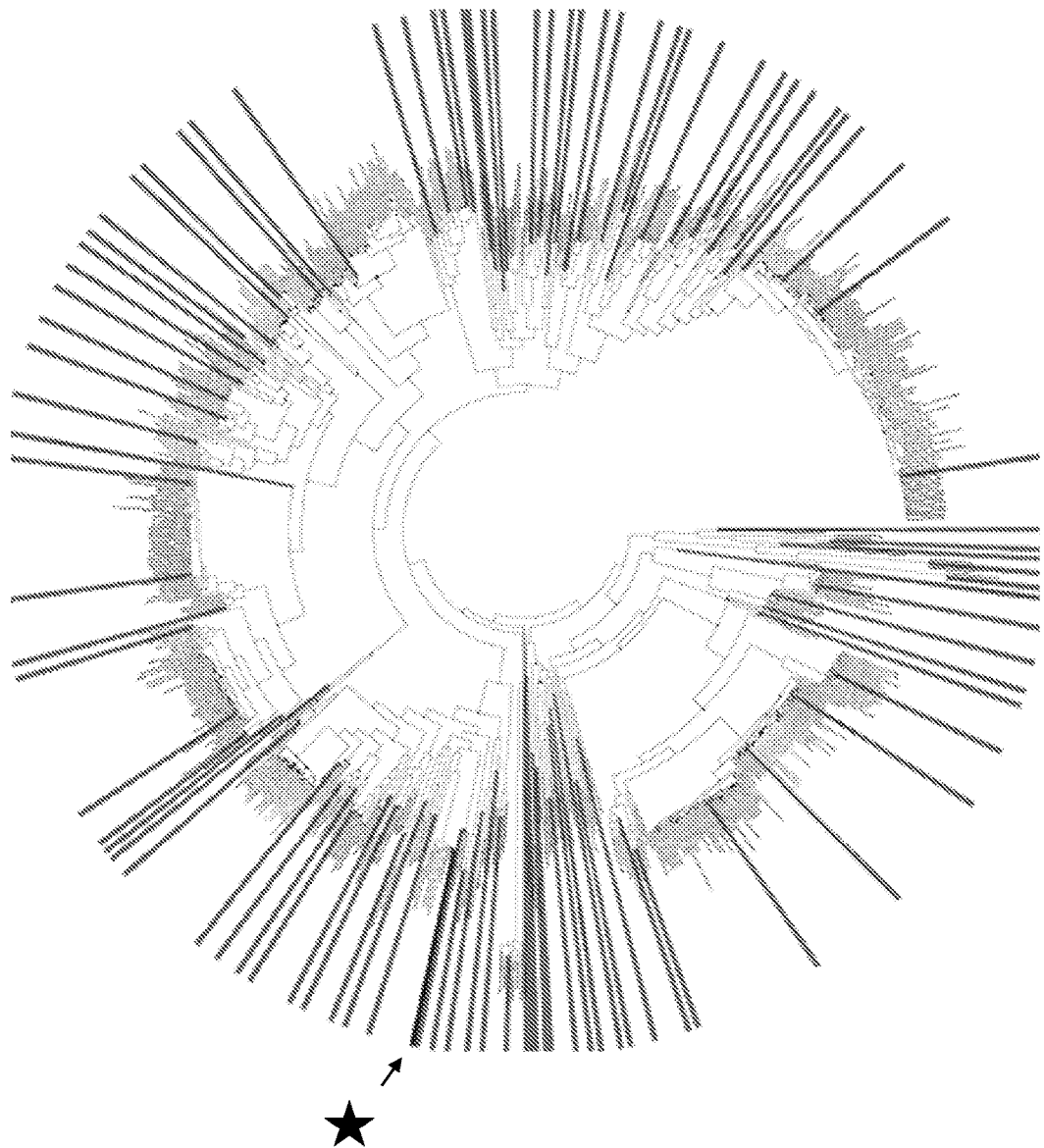
FIG. 3 depicts a complete phylogenetic tree of open reading frames discovered to have at least 30% identity to the P. cichorii enzyme (SEQ ID NO: 176).

To determine which of the candidate sequences from the phylogenetic tree depicted in FIG. 3 would be useful for converting fructose to allulose, an initial set of 96 candidate sequences representative of different sections of the phylogenetic tree from FIG. 3 were selected for screening and analysis. The selection of representative sequences intentionally excluded sequences for enzymes that had previously been identified as useful for fructose to allulose conversion except for the *P. cichorii* FA epimerase, which was useful as a control. The sequences selected for screening are indicated by the radial arms extending outward from the circular phylogenetic tree in FIG. 3. The position of the *P. cichorii* FA epimerase on the phylogenetic tree is highlighted for reference by a star.

Figure 5A:
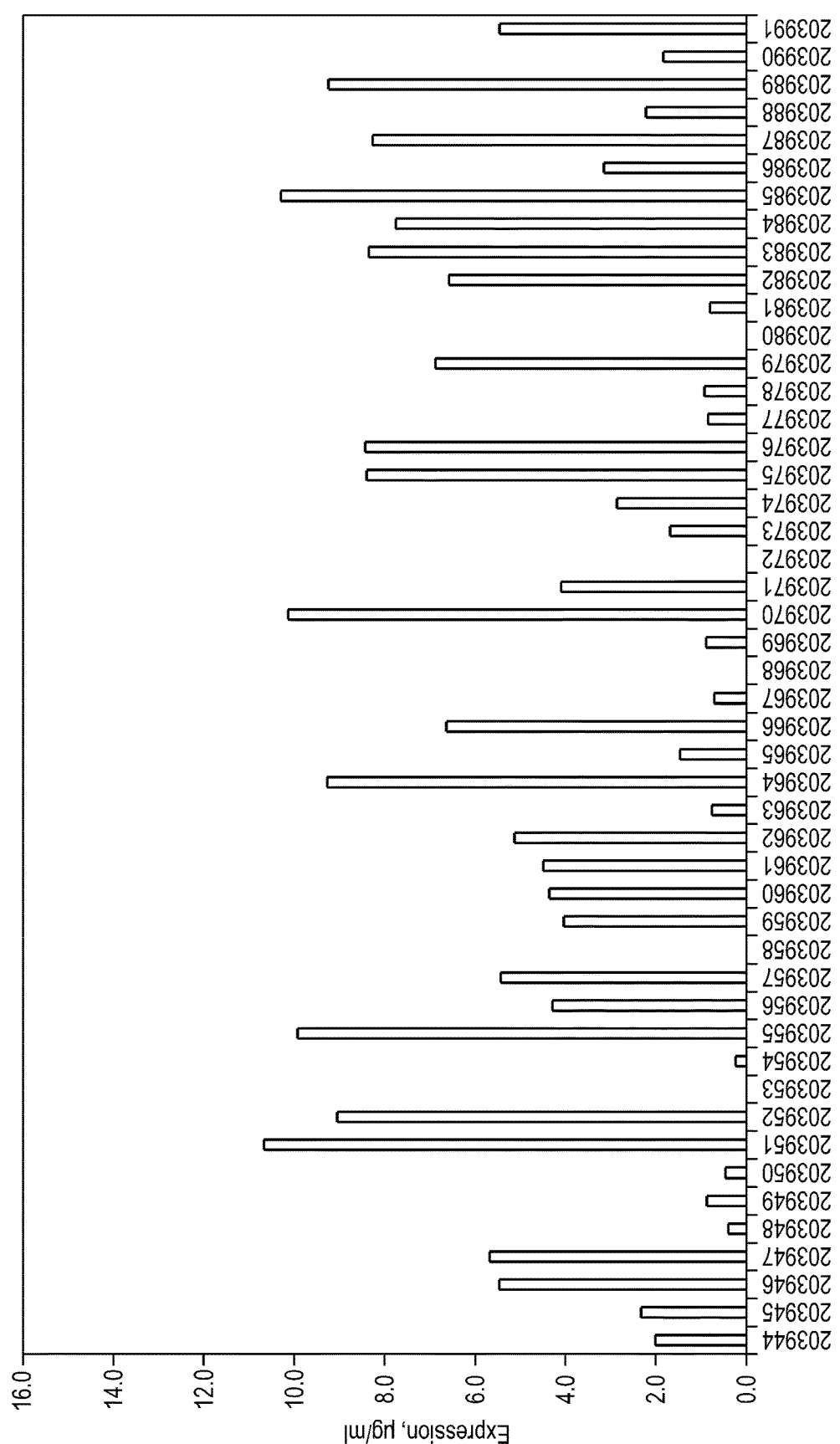
FIGS. 5A and 5B depicts protein expression levels in B. subtilis for 96 selected proteins. The black bars represent proteins that showed FA epimerase activity under the conditions tested. The gray bars represent proteins that showed no activity.
Figure 5B:
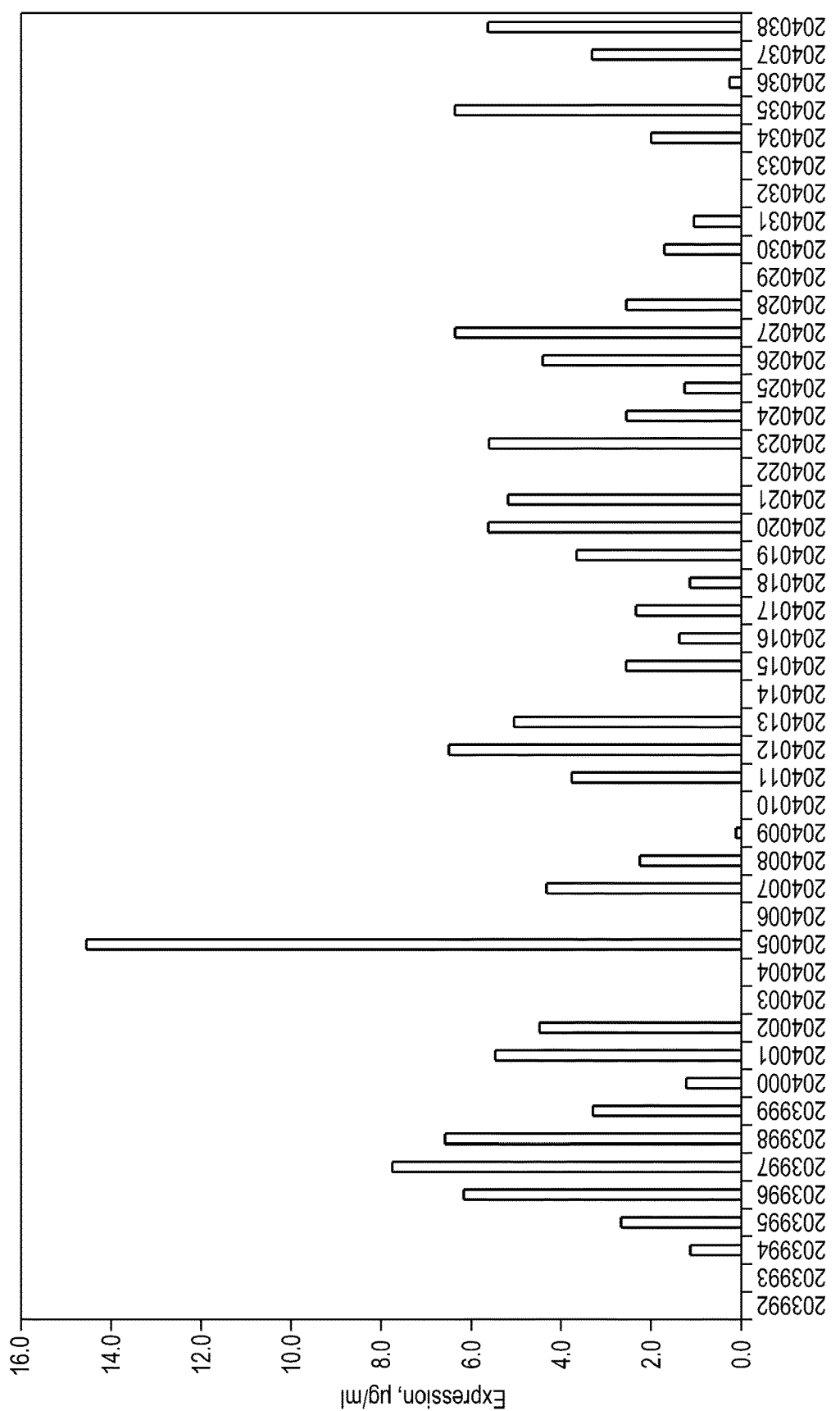

As done with the *P. cichorii* sequence, synthetic DNA sequences encoding the other 96 candidate protein sequences were designed with codons optimized for expression in *B. subtilis*. These were cloned into the same expression vector without a histidine tag used for expression of the *P. cichorii* enzyme. The *B. subtilis* transformants were again grown in media lacking $Co^{+2}$ and $Mn^{+2}$, and extracts were prepared and analyzed by polyacrylamide gel electrophoresis. To determine expression levels, the bands appearing on the polyacrylamide were scanned for relative density. As shown in FIG. 5, it was discovered that expression levels were highly variable, despite the proteins being of similar size and all having codons optimized for expression in *B. subtilis* and all being expressed from the same promoter and ribosomal binding site.

Figure 6:
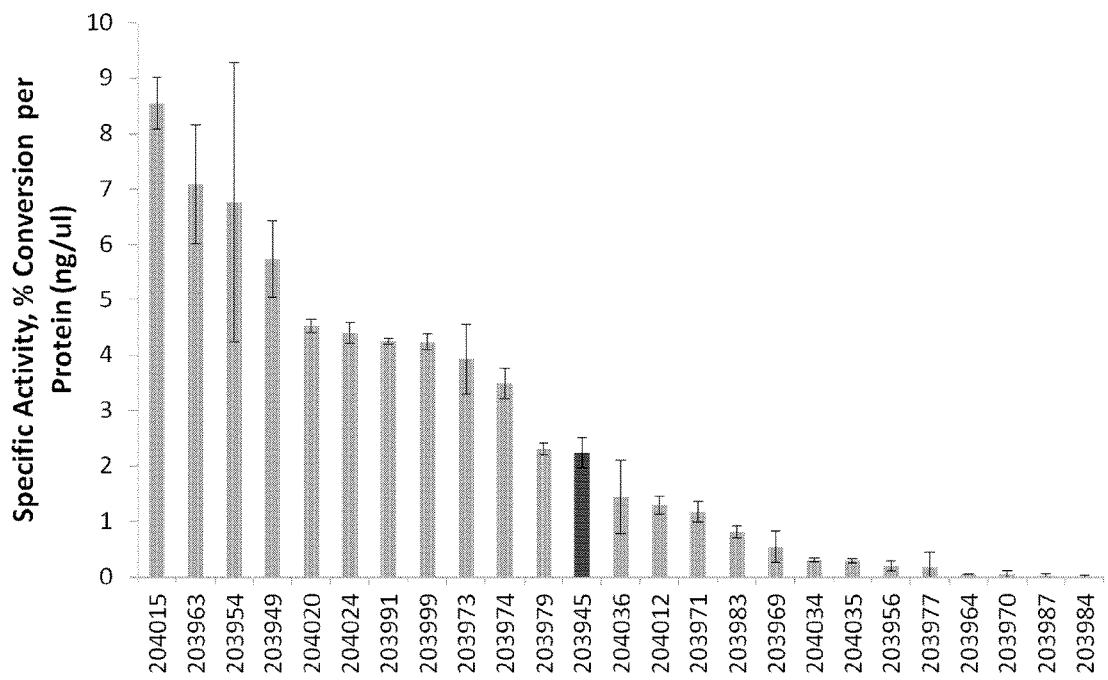
FIG. 6 depicts the level of FA epimerase activity for the selected 22 proteins that showed activity from FIG. 5.

The extracts from the 96 candidate sequences were assayed for FA epimerase specific activity in a buffer containing $Mg^{+2}$. HPLC was used to quantify fructose to allulose conversion. It was discovered that only 22 of the 96 candidates exhibited detectable FA epimerase activity. The screening assay cocktail contained 200 mM fructose, 5 mM $MgCl_2$, in 50 mM MES buffer pH 6.0 and the reaction was performed at 50° C. for 2 hours. As shown in FIG. 6 the activity levels varied widely. The activity level of the *F. plautti* (SEQ ID NO: 142) is highlighted in FIG. 5 as the black bar. *F. plautti* was determined as the threshold candidate for selection of the next group to be tested under more stringent conditions because it performed similarly to *P. cichorii* in the beginning stages of testing. Twelve of the 25 candidates that were tested in (as seen in FIG. 6) exhibited a higher specific activity than the *F. plautti* FA epimerase.

Figure 7:
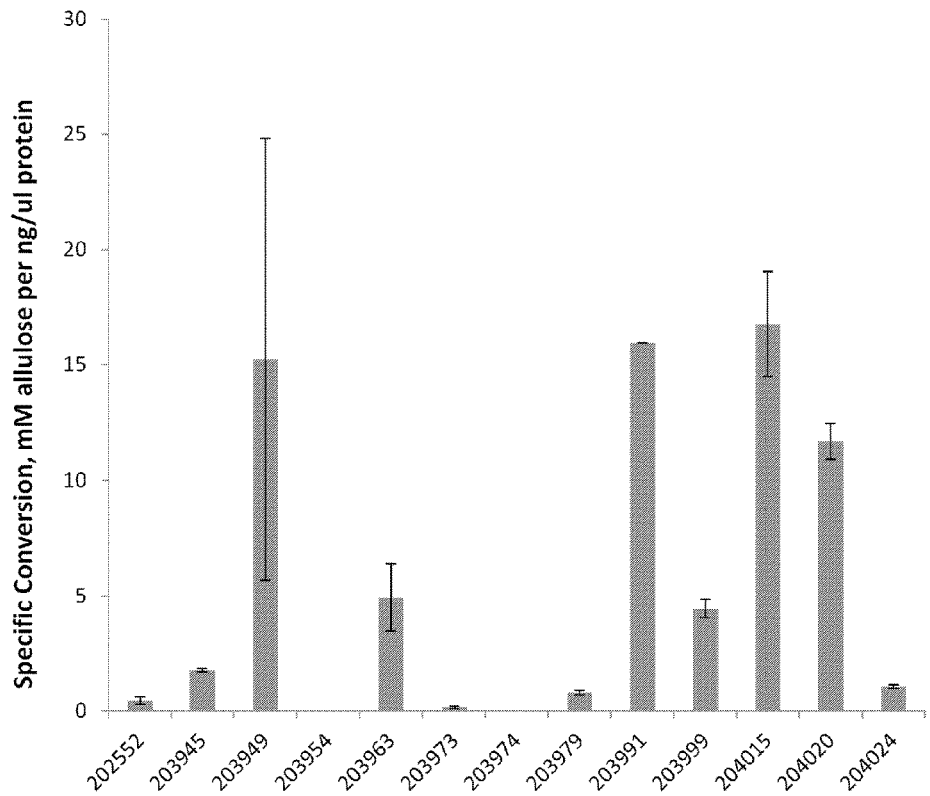
FIG. 7 depicts the FA epimerase activity of the top thirteen selected proteins under reaction conditions of 60T in 50% wt/wt fructose, 50 mM NaoAC and pH 5.0.

The 12 candidates showing greater specific activity than the *F. plautti* enzyme and the *F. plautti* enzyme itself were further screened for specific activity under conditions more representative of what would be desirable for commercial production of allulose from fructose, i.e., lower pH, higher temperature and higher dissolved fructose content. The reaction conditions were 50% wt/wt fructose, 5 mM $MgCl_2$, in 50 mM Na acetate buffer pH 5.0 and the reaction was performed at 60° C. for 2 hours. FIG. 7 shows the results of this screening which showed four candidates having relatively high levels of FA epimerase activity, which were clone 203949 which encodes SEQ ID NO: 116 from *Burkholderia* sp. Y123; clone 203991, which encodes SEQ ID NO: 52 from the red algae *Galdieria sulphuraria*; clone 204015, which encodes SEQ ID NO: 122 from a *Delftia* sp, and clone 204020, which encodes SEQ NO: 34 from *Burkholderia multivorans*. It was noted however, that as shown in FIG. 5, clone 203949 expressing the *Burkholderia* sp. Y123 FA epimerase showed relatively low levels of protein expression which was near the limit of accurate detectability so the error range in specific activity measurements was high. Nonetheless, because two clones from different *Burkholderia* species showed high levels of specific activity both candidates were considered suitable for commercial allulose production, with the caveat that expression levels of the enzyme from *Burkholderia* sp. Y123 would need to be improved for cost effective commercial scale production of the enzyme.

Figure 10:
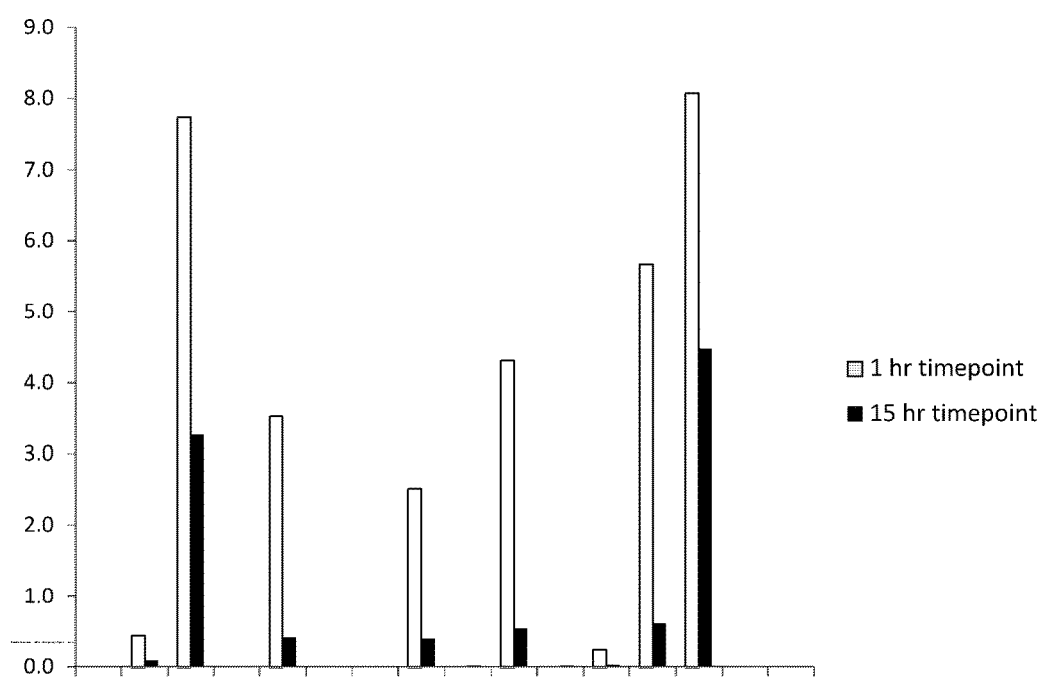
FIG. 10 depicts FA epimerase specific activity levels of the top 16 selected proteins at pH 70° C., pH 5.0, 50% wt/wt fructose.

The 12 candidates showing greater specific activity than the *F. plautti* enzyme FA, the *F. plautti* enzyme itself and the three other candidates representing the clones that showed the top 16 highest levels of specific FA epimerase activity from FIG. 10 were further screened for activity at low pH and even higher temperature. The reaction conditions for this round of analysis were 50% wt/wt fructose, 5 mM $MgCl_2$, in 50 mM Na acetate buffer pH 5.0 and the reaction was performed at 70° C. In addition, the specific activity levels were calculated from two different time periods of one hour and 15 hours to provide an indication of heat tolerance of the candidates. FIG. 10 shows that at 1 hour the same four candidates that showed the highest calculated specific activity at 60° C. for 2 hours also had the highest specific activity calculated for the reaction at 70° C. for 1 hour. The two candidates from the *Burkholderia* species also showed the highest level of specific activity calculated for the reaction at 15 hours, indicating that these candidates have higher thermal stability than others.

Figure 8:
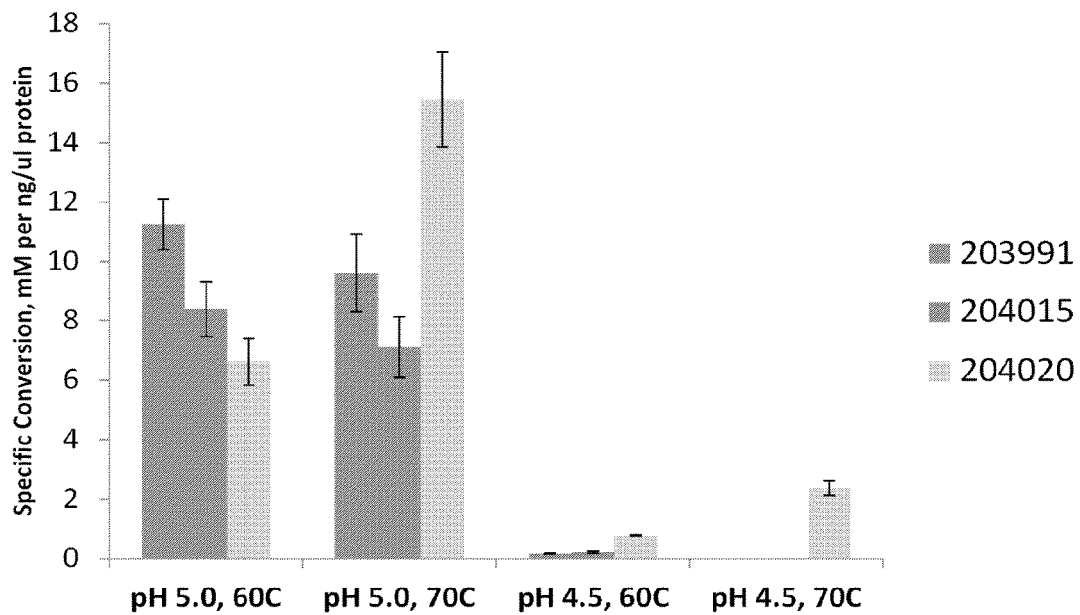
FIG. 8 depicts the activity levels of the top three selected proteins under different reaction conditions.
Figure 9:
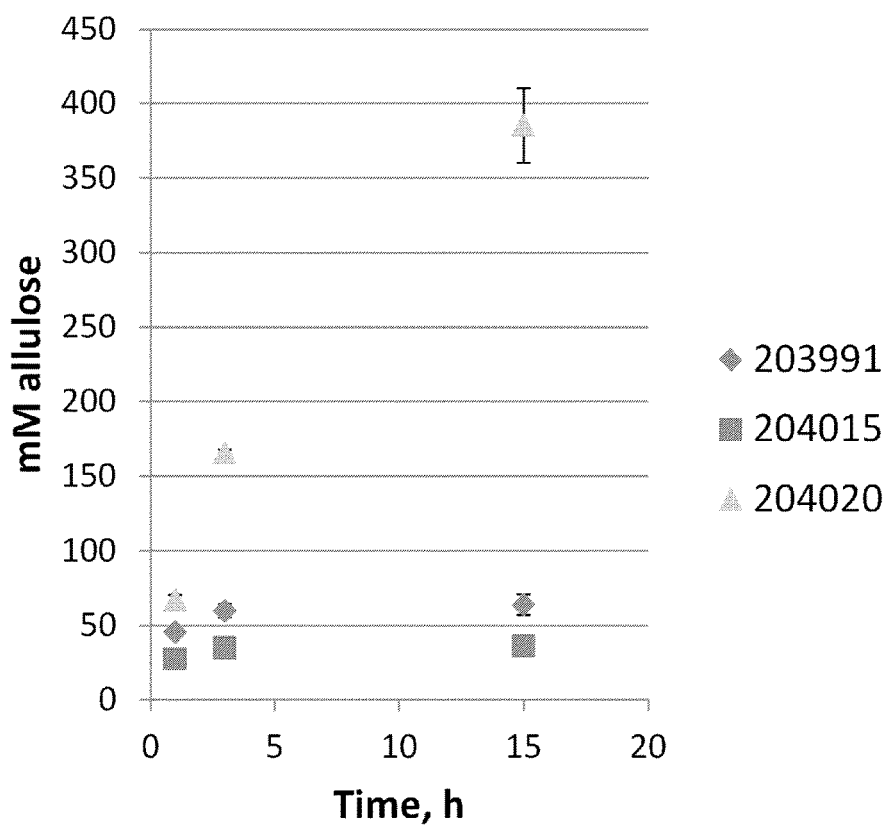
FIG. 9 depicts a time course of FA epimerase activity for the same three selected proteins from FIG. 8.

The three top performing candidates from the test at pH 5.0 at 60° C. with 50% fructose were also tested for activity with the same amount of fructose at pH 4.5 and at temperature of 70° C. for 2 hours. FIG. 8 shows that at pH 4.5 all three candidates showed reduced specific activity, but of these, only the candidate from *Burkholderia multivorans* (clone 204020) showed any activity at pH 4.5 at 70° C. To further test for long term activity, a reaction at 70° C., pH 5.0 with 50% wt/wt fructose and 5 mM MgCL2 was run for the same three candidates for a period of 15 hours and time points were taken at 1.5, 3.5 and 15 hours. FIG. 9 shows that clone 204020 exceeded the other three candidates for retaining long term activity at this higher temperature.

Figure 4:
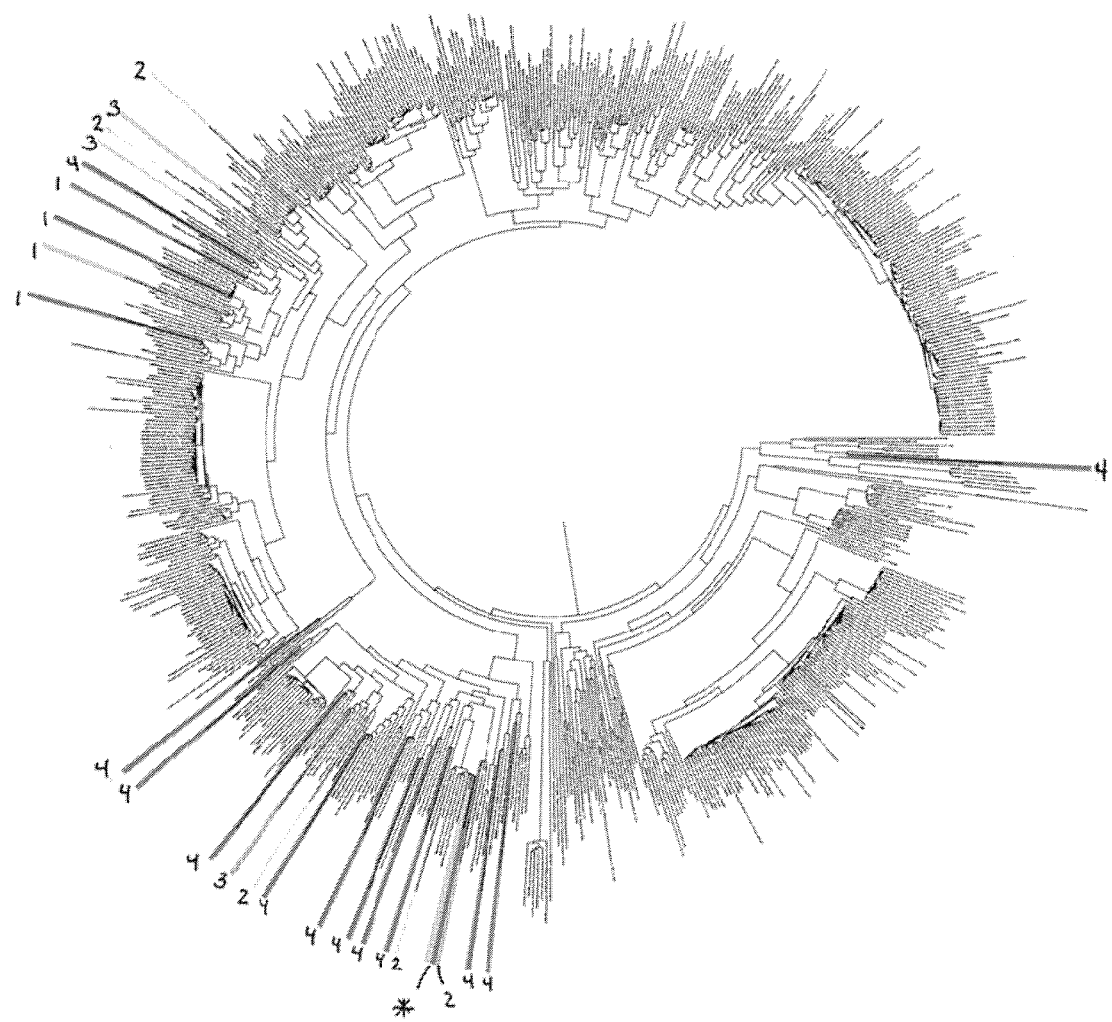
FIG. 4 depicts the same phylogenetic tree showing selected proteins discovered to have FA epimerase activity.

To determine what phylogenetic families of FA epimerase are suitable for production of allulose from fructose, the entire set of 25 candidates that showed any FA epimerase activity were mapped onto the same phylogenetic tree depicted in FIG. 3 for the 660 sequences discovered in the initial round of database screening. FIG. 4 shows the phylogenetic mapping of the relative specific activity levels of these 25 candidates determined by the tests described above. The relative specific activity levels are indicated by numeric coding with #1 being the highest, #2 relatively high, and #3 relatively low, and #4 being lowest. For reference, the level of activity for the *P. cichorii* FA epimerase is in the #3 level and indicated by an * in FIG. 4.

Analysis of the phylogenetic mapping indicated two distinct clusters of related amino acid sequences which show FA epimerase activity that is likely suitable for converting fructose to allulose on a commercial scale. The highest levels of activities are shown for the genus located at approximately the 10 o'clock position on the phylogenetic map in FIG. 4. This is the genus that contains the four candidates showing the highest levels of comparative specific activity, which again were clone 203949, which encodes SEQ ID NO: 116 from *Bulkholderia* SP Y123, clone 203991, which encodes SEQ ID NO: 52 from the red algae *Galdieria sulphuraria*; clone 204015, which encodes SEQ ID NO: 122 from a *Delftia* sp, and clone 204020, which encodes. SEQ NO: 34 from a different *Burkholderia multivorans*. A second cluster located at approximately the 7 o'clock position on the phylogenetic map is the cluster that contains the *P. cichorii* FA epimerase and other FA epimerases known in the prior art to be useful for the production of allulose from fructose such as *Bulkholderia* RP64 as disclosed in PCT/US16/24217 which encodes SEQ ID NO: 168, *Desmospora* sp. 8437 which encodes SEQ ID NO: 170, *Clostridium cellulolyticum* as disclosed in WO2015/032761A1 which encodes SEQ ID NO: 178 and a variant of the *Clostridium cellulolyticum* as disclosed in WO2015/032761A1 which encodes SEQ ID NO: 180.

By doing genetic sequence inheritance analysis using methods described in MEGA6: *Molecular Evolutionary Genetics Analysis Version 6.0*. Tamura K, Stecher G, Peterson D, Filipski A, and Kumar S (2013), *Molecular Biology and Evolution* 30:2725-2729, it was determined that the cluster at the 10 o'clock region stems from a common ancestral amino acid sequence indicated in FIG. 11 as node 12 (appears as a dot with 12 by it). A hypothetical amino acid sequence for a protein corresponding to node 12 is provided as SEQ ID NO: 24. Node 12 splits into two sub nodes representing two different sub geneses indicated by nodes 11 and 6. Hypothetical amino acid sequence for these ancestral node protein sequences are provided as SEQ ID NO: 12 for node 6, and SEQ ID NO: 22 for node 11. In addition, node 12 has a third unlabeled node lying between nodes 11 and 6, highlighted by a star on FIG. 11. The proteins encoded by species that descend from this third node include proteins previously known to exhibit FA epimerase activity such as SEQ ID NO: 166 derived from *Arthrobacter globiformis*.

Synthetic DNA sequences encoding the proteins defined by SEQ ID NO: 12 and SEQ ID NO: 22 representing the ancestral proteins at nodes 6 and 11 were designed and made to include codons to optimize expression in *B. subtilis*. These were cloned into the same expression vector used to express the original 96 candidate sequences and the cells were grown and assayed for FA epimerase activity in the presence of $Mg^{+2}$ as done for the original candidates. Both proteins having these hypothetical ancestral amino acid sequences exhibited the desired fructose to allulose epimerase activity as did each of SEQ ID NO's 34, 48, 52, 64, 84, 100, 116 and 122 which were all the species under these sub nodes that were randomly selected as candidate sequences. Accordingly, all the species of FA epimerases that descend from node 6 are expected to have a fructose to allulose activity suitable for use in commercial allulose production.

In order to relate the individual species of FA epimerase enzymes found by database mining to their ancestral sub node sequences, hypothetical ancestor proteins represented by nodes 10, 9, 8, and 7 were created by the same algorithm used to postulate ancestral proteins (MEGA6 software) for nodes 12, 11 and 6. The ancestral amino acid sequences representing nodes 10, 9, 8, and 7 are provided as SEQ ID Nos 20, 18, 16, and 14, respectively all have the desired FA epimerase activity as do all species actually tested that descend from these nodes (SEQ ID NO. 34, 48, and 52). Accordingly, it is concluded that any protein sequence having the following relationships in sequence identity to node 11 will have the desired FA epimerase activity. Such relationships are: 64.2% amino acid sequence identity to SEQ ID NO: 22, 72.7% amino acid sequence identity to SEQ ID NO: 20, 80.8% amino acid sequence identity to SEQ ID NO: 18, 88.2% amino acid sequence identity to SEQ ID NO: 16, and 97.3% amino acid sequence identity to SEQ ID NO: 14.

The same was done to create hypothetical descendants from node 6 represented by nodes 5, 4, 3, 2 and 1. These are provided as SEQ ID Nos 10, 8, 6, 4, and 2. The amino acid sequence represented by node 6 has the desired FA epimerase activity as do all species actually tested that descend from this node (SEQ ID NO: 84, 100, 116, and 122), therefore is concluded that any protein sequence having the following relationships in sequence identity to node 6 will have the desired epimerase activity suitable for commercial production of fructose to allulose. Such relationships are: 61.1% amino acid sequence identity to SEQ ID NO: 10, 76.8% amino acid sequence identity to SEQ ID NO: 8, 80.3% amino acid sequence identity to SEQ ID NO: 6, 87.2% amino acid sequence identity to SEQ ID NO: 4, and 98.6% amino acid sequence identity to SEQ ID NO: 2.

The sequences from the 10 o'clock region that have the aforementioned sequence identity to the ancestral nodes 10 and 6 were not previously known to be useful for the production of allulose from fructose. Indeed, inspection of the database notations of these untested sequences indicates a variety of predicted activities such as xylose isomerase, hypothetical protein, sugar phosphate isomerase, AP endonuclease, and putative sugar phosphate isomerase. However, the data provided herein demonstrates that all of these sequences will have FA epimerase activities.

The tested sequences from the 7 o'clock region, which as a group generally show lower levels of FA epimerase activity than those from the 10 o'clock region, do not share the same ancestral decadency that demonstrates novelty of a genus having certain sequence identities to ancestral sequences. Nonetheless, the screening done for the present work revealed several amino acid sequences that were not definitively known prior to the present work to exhibit an FA epimerase activity suitable for production of allulose from fructose. The members of this group are SEQ ID NO: 136, 138, 140, 142, 144, 146, 148, 150, 152, 154, 156, 158, 160, 162, and 164, all of which were species tested for FA epimerase activity.

Specific Details

The epimerase enzyme (*P. cichorii*) was first cloned into *E. coli* using the method as follows. The *P. cichorii* epimerase enzyme, according to SEQ ID NO: 176 was codon optimized using codon optimization software, many of which are commonly known in the art. SEQ ID NO: 181 is the codon optimized nucleotide sequence of the *P. cichorii* FA epimerase gene for expression in *E. coli*, which was cloned into the DNA2.0 vector pD861-SR via the Electra method (DNA2.0).

The pD861-SR construct harboring the *P. cichorii* epimerase gene optimized for expression in *E. coli* was used to transform *E. coli* strain BL21. Transformants were selected and cultured in Luria Broth (LB) media supplemented with 30 ug/ml kanamycin (Teknova) at 37° C. for 16 h. 40 uL of this culture was used to inoculate 2 ml of fresh media and the resulting culture was incubated at 37° C. to mid-log growth (OD at 600 nm of ~0.8). The culture was then induced with 4 mM rhamnose and incubation was continued at 37° C. for 4 hours. Cells were harvested by centrifugation, twice frozen and thawed, and lysed using the Peripreps full lysis protocol (Epicentre). The soluble protein in the lysates were prepared by collection of the supernatants fractions after centrifugation of the crude lysates.

The *P. cichorii* epimerase enzyme, according to SEQ ID NO: 176 was additionally codon optimized using codon optimization software, many of which are commonly known in the art to express FA epimerase activity in the *B. subtilis* expression system. The codon optimized nucleotide sequence that was synthesized is according to SEQ ID NO: 182, which was cloned into the expression vector pHT254 (Mobitech) at the BamHI and XmaI sites for expression in *B. subtilis*.

The pHT254 construct harboring the *P cichorii* FA epimerase gene that was codon optimized for expression in *B. subtilis* was used to transform *B. subtilis* strain DP1077. Transformants were selected and cultured in either custom Azure media lacking $Mn^{2+}$ and $Co^{2+}$ (Teknova) supplemented with 1% glucose and 5 ug/ml chloramphenicol or in Davis minimal media (HiMedia) supplemented with 2 g/L SC amino acids (MP Biomedicals), 1% glucose, and 5 ug/ml chloramphenicol. Cultures were grown at 37° C. for 16 h. 40 uL of this culture was used to inoculate 2 ml of fresh media and the resulting culture was incubated at 37° C. to mid-log growth (OD at 600 nm of ~0.7). The culture was then induced with 1 mM IPTG and incubation was continued at 37° C. for 4 hours or 24° C. for 20 h. Cells were harvested by centrifugation, twice frozen and thawed, and lysed using the Peripreps full lysis protocol (Epicentre). The soluble protein in the lysates were prepared by collection of the supernatants fractions after centrifugation of the crude lysates.

Epimerase protein levels in crude and soluble lysates from both the *E. coli* expression system and the *B. subtilis* expression system were analyzed by polyacrylamide gel electrophoresis on 4-12% Bis-Tris NuPAGE gels (Invitrogen). Protein levels were determined by densitometry of gels stained with SimplyBlue Safe Stain (Invitrogen) using protein quantification standards.

For epimerase activity screening of both the *E. coli* and the *B. subtilis* derived lysates, reactions were assayed in a volume of 100 μL: 10% v/v clarified lysate, 200 mM fructose, 50 mM MES, pH 6.0, and 5 mM $MgCl_2$. Reactions were incubated at 50° C. for 2 h and stopped by addition of 10% volume 2% HCl and chilling to 4° C. Reactions were filtered through a PES membrane at a 10 kDa molecular weight cutoff (Pall) prior to HPLC analysis.

All 96 homologs sequences were engineered into pHT254. The vector (pHT254) utilized for this work was obtained from MoBiTech, Inc. The vector expresses the gene of interest from a strong Pgrac100 promoter which is derived from the promoter preceding the groESL operon of *Bacillus subtilis*. It contains improved regulatory elements fused to the lac operator allowing induction by IPTG and a strong ribosomal binding site. Nucleotides were optimized at the conserved regions of the groESL promoter including the UP element, the −35 and the −15 region (Phan et al, 2012). Each gene was cloned into expression vector pHT254 at the BamHI and XmaI restriction sites.

The 96 homologs were then transformed into DB1077 strain. *Bacillus subtilis* strain DP1077 is a sporulation-defective (ΔspoIIG::ZeoR) derivative of the *Bacillus* Genetic Stock Center strain 1A976 (Em his nprE18 aprE3 eglS(DELTA)102 bglT/bglS(DELTA)EV lacA::PxylA-comK). In addition to being sporulation defective the strain is defective in the ability to secrete neutral protease and subtilisin as a result of mutations in the nprE and aprE genes, respectively. The strain additionally bears an expression cassette placing the competence factor, comK, under the control of a xylose-inducible promoter for the simple production of competent cells.

*B. subtilis* strain DP1077 was transformed with each of the 96 expression constructs and cells were selected on LB agar media containing 5 μg/mL chloramphenicol.

The 96 *B. subtilis* transformants were picked to Davis minimal media.

Davis minimal media is made by using reagent grade water and in a final volume of 1 L, 10.6 g Minimal Broth Davis w/o Dextrose (HIMEDIA cat. no. M390-500G) with 2 g of SC Nucleotide Mixture (MP Biomedicals cat. no. 4400-022). Autoclave for 15 min at 121° C. Prior to use add glucose to 1% and chloramphenicol at 5 ug/ml.

For FA epimerase screening, transformants were picked to 600 μL Davis minimal media (HiMedia) supplemented with 2 g/L SC nucleotides (MP Biomedicals), 1% glucose, and 5 μg/mL chloramphenicol. Cells were grown to mid-log at 37° C., then induced with IPTG for 20h at 24° C. Cells were harvested by centrifugation and lysed using the PeriPreps lysis protocol (Epicentre) in a final volume of 75 μL. Soluble protein expression was analyzed by polyacrylamide gel electrophoresis on 4-12% Bis-Tris NuPAGE gels (Invitrogen) and protein levels were determined by densitometry against quantitation standards. Soluble epimerase recovered ranged from 1-10 μg/mL of culture.

FA Epimerase expression levels were assayed in a reaction volume of 100 μL: 10% v/v clarified lysate, 200 mM fructose, 50 mM MES, pH 6.0, and 5 mM MgCl2. Reactions were incubated at 50° C. for 2 h and stopped by addition of 10% volume 2% HCl and chilling to 4° C. Reactions were filtered through a PES membrane at a 10 kDa molecular weight cutoff (Pall) prior to HPLC analysis.

Multiple sequence alignments were done using methods described in Larkin M A, Blackshields G, Brown N P, Chenna R, McGettigan P A, McWilliam H, Valentin F, Wallace I M, Wilm A, Lopez R, Thompson J D, Gibson T J, Higgins D G. (2007). *Clustal W and Clustal X version* 2.0. *Bioinformatics*, 23, 2947-2948.

Figure 14:
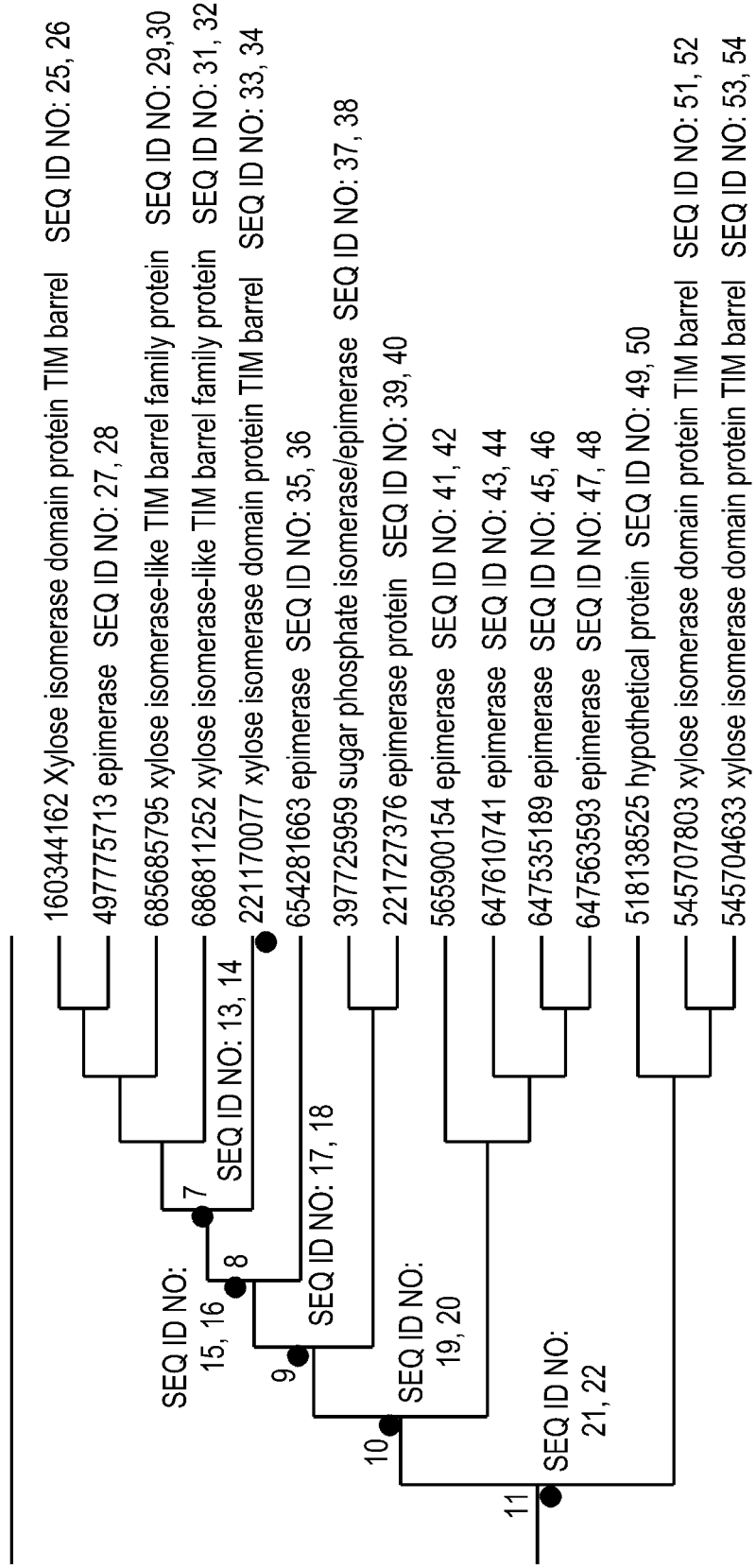
FIG. 14 depicts a zoomed in area of the node 11 area with appropriate SEQ ID NO's marked for the nodes and the individual proteins.
Figure 15:
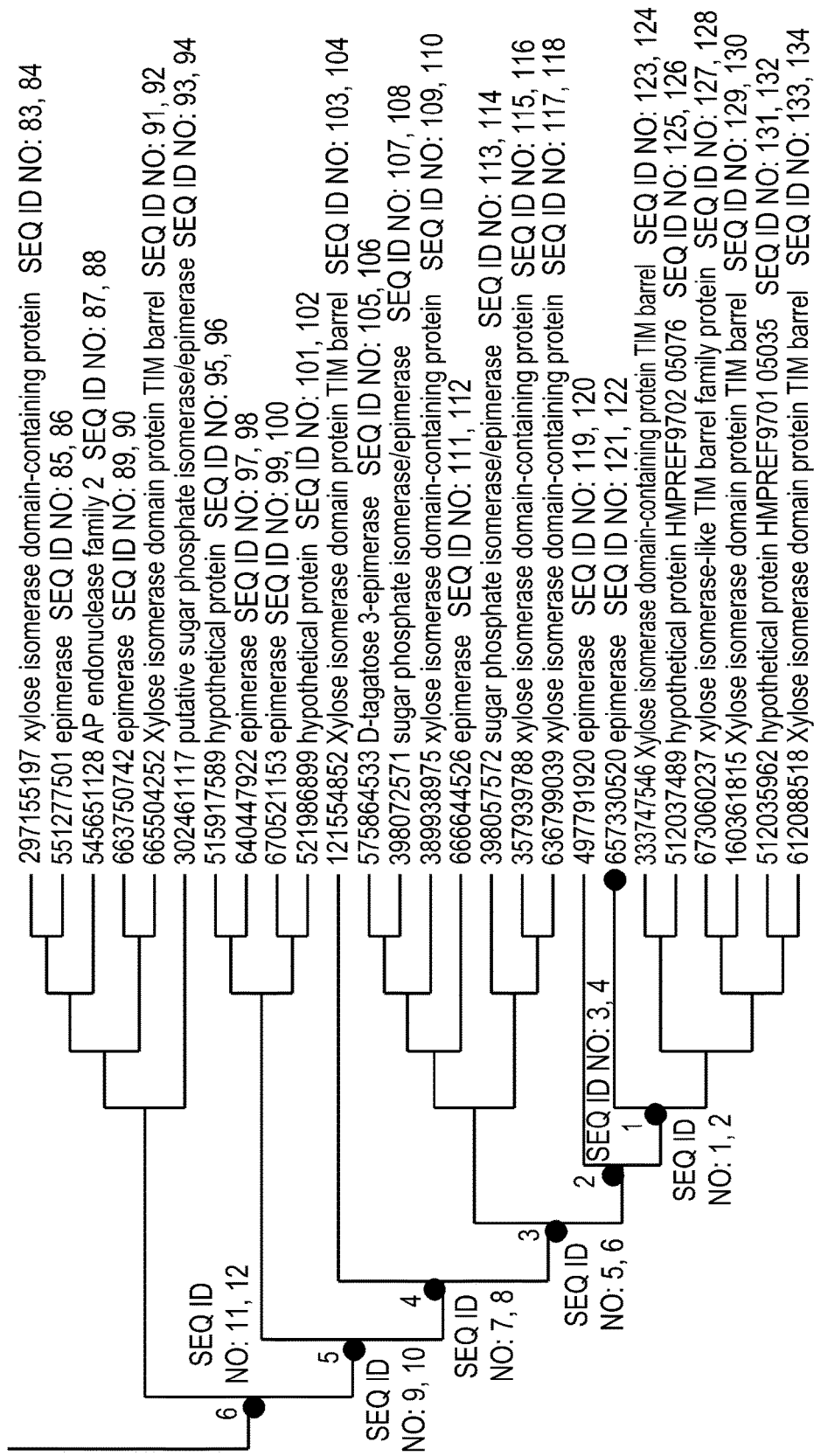
FIG. 15 depicts a zoomed in area of the Node 6 area with appropriate SEQ ID NO's marked for the nodes and the individual proteins.

Percent identities were calculated using Lasergene 12 software package from DNASTAR, Inc. Results of the sequence alignment and percent identities can be seen in FIGS. 12-13, which are separated out according to relation to ancestral nodes. The percent identities for the Node 11 area (highlighted in FIG. 11 by the dash lined box) and as seen in FIG. 14, can be seen in FIG. 12.

FIG. 12 clearly shows that all of the sequences in the Node 11 area have a higher percent identity to all of the nodes 7-12 than they do to SEQ ID NO: 166, 168 or 170, which are all proteins previously known to express FA epimerase activity.

Figure 11:
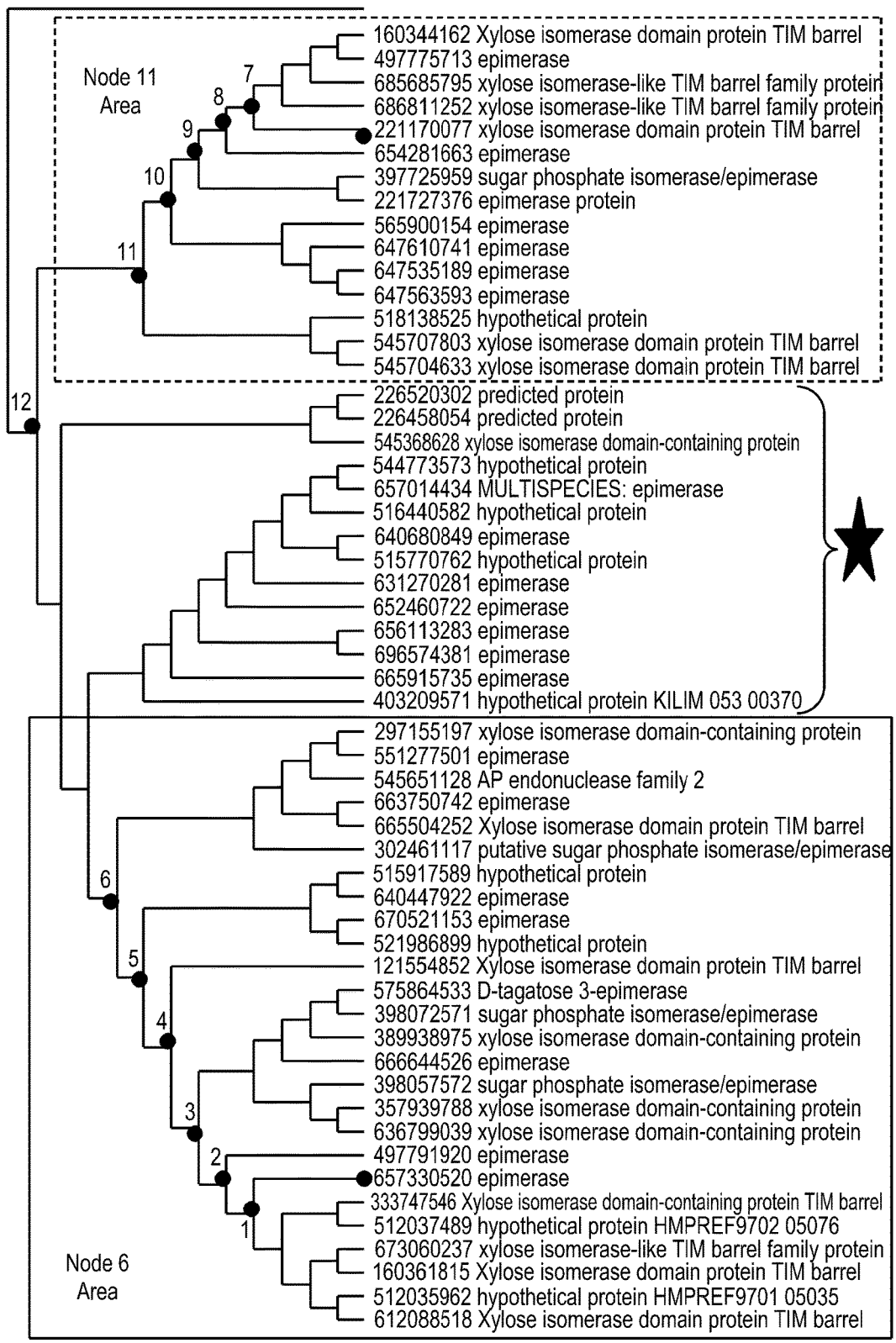
FIG. 11 depicts a zoomed in image of the 10 o'clock region of the phylogenetic tree from FIG. 4.

The other genus is herein described as the Node 6 area and is highlighted in FIG. 11 by solid lined box. All species of this genus relate to the 204015 candidate. These can be more clearly seen in FIG. 15, along with SEQ ID NO's associated for each of them. The percent identities of the Node 6 area can be seen in FIG. 13 which shows that all of the sequences in the Node 6 area have a higher percent identity to all of the nodes 1-6 than they do to any of the known sequences previously described in the art, more specifically SEQ ID NO: 166, 168, and 170.

None of the sequences in the art of record have the same level of amino acid sequence identity to the ancestral nodes as the FA epimerase disclosed herein, which is shown in FIG. 17.

Although exemplified herein by expression in *E. coli* and *B. subtilis*, any nucleic acid encoding a species from the genus of FA epimerases disclosed herein may be engineered to be expressed in other suitable microorganisms commonly used to express enzymes for industrial scale production. Suitable other organisms include, but are not limited to *Bacillus licheniformis*, *Saccharomyces cerevisiae*, *Schizosaccharomyces ombe*, *Pseudomonas putida*, *Pichia* sp. *Aspergillus* sp., *Trichoderma reesei* and *Corynebacterium glutamicum*. Vectors containing promoters and other necessary regulatory sequences to express any protein in these organisms are known and readily available to those of ordinary skill in the art.

The FA epimerases proteins can be used for commercial scale production of allulose from fructose, most typically by binding the protein or extract from a microorganism containing the protein to a solid matrix and passing a flow of an input stream containing fructose over the matrix to convert at least a portion of the fructose to allulose and recovering an output stream containing allulose and fructose. Optionally, the allulose may be separated from other components in the output stream, and may additionally be concentrated. Many solid matrices suitable for binding enzymes are well known in the art. Exemplary solid matrices include. XAD 2, XAD4, XAD8, XAD16 available from Sigma Aldrich, DowA568 available from Dow Chemical, and Purolite ECR8415 and ECR 8314 from Purolite. An example of an FA epimerase being immobilized on such a column is shown in PCT/US16/24217, which is incorporated herein by reference in its entirety.

Alternatively, the microorganism expressing the FA epimerase may be permeabilized and immobilized on alginate beads such as described in U.S. Pat. No. 8,735,106, additionally incorporated herein by reference in its entirety, or onto clays, carbon, diatomaceous earth or a hydrogel such as poly acrylamide.

SEQUENCE LISTING (190 sequences)

SEQ ID NO: 1 - DNA, 885 bp, Artificial Sequence
  Synthetic
ggatccatgaacccacttggaattcacgcattagtttgggccggagatttatcaccagcgtctacaagacatgtaattgagcaaacacgccaggccggatacgacttagttgaattgagtttacatggaccgcgtttaatggatttagcattgacgcgagatctattacaagagcatggtttaggtgtcgggtgcagccgtggtttgacttttgaggccgatgtctcctccgaagatccggccgttgttgcgaggggtctggcattattacaagaaggtgtagatatcactgcgcgcctcggtggacggtattttggtggaatcctctatggtgcgatggccaaatacgggcatccatgtacgccccagggtagacgtaacgcgattgaagccgtccgtcgcattgcggacttcgcgggagagcgtggagtaactctaggattagaagtcgtgaaccgctatgagtctaatttgctgaatacggcagcacaagcgctggaattcattgatgaggtcggccagccgcatgtatgtgtacatctggacacctatcacatgaatattgaagaagccgatttagccgcacctgtattagcgtgtggtcaacgtcttggttacgtccatattggagagaaccaccgtgggtatcttggggctggacatattgactttgcacaatttttcggagcgttagcgcagattggttatcagggtactgtaacctttgagagctttagtagtgcaattgtcaatgaacaactctcaaatgcactagcgatttggcgcccgatgtgggaagatggaatggatctagccttacatgctcgtggatttatggcagacggattagcgagcgcacaacaagctcgggcttgataacccggg

SEQ ID NO: 2 - protein, 289 aa, Artificial Sequence
  Synthetic
MNPLGIHALVWAGDLSPASTRHVIEQTRQAGYDLVELSLHGPRLMDLALTRDLLQEHGLGVGCSRGLTFEADVSSEDPAVVARGLALLQEGVDITARLGGRYFGGILYGAMAKYGHPCTPQGRRNAIEAVRRIADFAGERGVTLGLEVVNRYESNLLNTAAQALEFIDEVGQPHVCVHLDTYHMNIEEADLAAPVLACGQRLGYVHIGENHRGYLGAGHIDFAQFFGALAQIGYQGTVTFESFSSAIVNEQLSNALAIWRPMWEDGMDLALHARGFMADGLASAQQARA

SEQ ID NO: 3 - DNA, 885 bp, Artificial Sequence
  Synthetic
ggatccatgaaccccttaggaattcacgcattagtctgggccggagatttatcaccagcgtctacaagacgcgtaatttcacaaacacgccgggccggatacgatttagttgaattaagtttacatggaccgcgtttaatggatttagcattgacgcgagatctattacaagagcatggtttacaggtcgggtgctctcgtggtttgacttttgatgccgatgtcagttccgaggacccggccgttgttgctaggggtgtcgcattattagaggaaggtgtaagcatcactgcggaactcggtggacggtattttggtggaatcctctatggtgcgatggccaaatacgcacatccatgtacggcgcagggtagacgtaacgcagtagaagccgtcaaacgcattgcggacttcgcgggagagcgtggagtaactttgggactagaagtcgtgaaccgctatgagtctaatttgctgaatacggcaactcaagcgctggaaatgattgatgaggtcggccagccgaatgtaaaagtacatctggacacctatcacatgaatattgaagaagccgattttatgcaacctgtattagcgtgtggtgaacgtcttggttacgtccatattggagagtcccaccgtgggtatcttgggagtggaacgattgactttgcacaatttttccatgcgttagcgatgattggttatcagggtgtagtaacctttgagagcttcagcagtaccgttgtcaatgaacaactctcaaatgcactagcgatttggcgcaacttatgggatgatggaatggatctagcccgccatgctcgtggatttatggcagacggattagcgagcgcacaacaagctcgtgcttgataacccggg

SEQ ID NO: 4 - protein, 289 aa, Artificial Sequence
  Synthetic
MNPLGIHALVWAGDLSPASTRRVISQTRRAGYDLVELSLHGPRLMDLALTRDLLQEHGLQVGCSRGLTFDADVSSEDPAVVARGVALLEEGVSITAELGGRYFGGILYGAMAKYAHPCTAQGRRNAVEAVKRIADFAGERGVTLGLEVVNRYESNLLNTATQALEMIDEVGQPNVKVHLDTYHMNIEEADFMQPVLACGERLGYVHIGESHRGYLGSGTIDFAQFFHALAMIGYQGVVTFESFSSTVVNEQLSNALAIWRNLWDDGMDLARHARGFMADGLASAQQARA

SEQ ID NO: 5 - DNA, 885 bp, Artificial Sequence
  Synthetic
ggatccatgaacccattaggaattcacgcattagtctgggccggagatttatcaccagcgtctactagaaaagtaattagccaaaccaaacgcgccggatacgacttagttgaacttagtttacatggaccgcgtgtaatggatttagcattgacgcgagatctattacaagagcatggtttacagattgggtgttctcgtggtttgacttttgatgccgatgtcagttccgaagatccggccgttgttgcgaggggagtagcattattagaggaaggtgtatccatcactgccgagctcggtggaaaatattttggtggaatcctctatggtgcgatggccaaatacccgcatcccgtaacggcgcagggtagacgtaacgctgtggaaagtttaaaacgcattgcggacttcgcggcagagaaaggtgtaactttgggactagaagtcgtgaaccgctatgagtccaacttgctgaatacggcaagtcaagcgctggaaatgattgatgaggtcggccagccgaatgtcaaggtacatctggacacctatcacatgaatattgaagaatctgatttcatgcaacctgttttagcgtgtggtgagcggcttggttacgtccatattggagagtcacaccgtgggtatcttgggagtggaacaattgactttgcacaatttttccatgcgttagcgatgattggttatcagggtgtcgtaacctttgagagctttagtagcacggtagtcaatgaacaactctcaaatgcactagcgatttggcgcaacttatgggatgatggaatggatctagccaaacatgctcgtggatttatggcagacggattagcgagcgcacaacaagctcgtgcttgataacccggg

SEQ ID NO: 6 - protein, 289 aa, Artificial Sequence
  Synthetic
MNPLGIHALVWAGDLSPASTRKVISQTKRAGYDLVELSLHGPRVMDLALTRDLLQEHGLQIGCSRGLTFDADVSSEDPAVVARGVALLEEGVSITAELGGKYFGGILYGAMAKYPHPVTAQGRRNAVESLKRIADFAAEKGVTLGLEVVNRYESNLLNTASQALEMIDEVGQPNVKVHLDTYHMNIEESDFMQPVLACGERLGYVHIGESHRGYLGSGTIDFAQFFHALAMIGYQGVVTFESFSSTVVNEQLSNALAIWRNLWDDGMDLAKHARGFMADGLASAQQARA

SEQ ID NO: 7 - DNA, 885 bp, Artificial Sequence
  Synthetic
ggatccatgaacccattaggaattcacgcattagtctgggccggagatttatcaccagcgtctacaagaaaagtaattgaacaaactaagcgcgccggatacgatttagttgaattgagtttacatggaccgcgggtgatggatattgcattgacgcgagatctattacaagagcatggtttacaaatcgcctgttctcgtggtttgtcctttgatgccgatgtcagttccgaggaccccgaagttgttgcgaggggtgtcgcattattagaagagggtgtaactatcactgctgagctcggtggaaaatattttggtggagtactctatggtgcgctcgccaaatacccgcgtccagtcaccgcgcagggtagacgtaacgccgtagaaagcctgaaacgcattgcggacttcgcagcagagaaaggtgtaactctaggattagaagtcgtgaaccgctatgagtctaatttgctgaatacggcatcacaagcgttagaaatgattgatgaggtcggccagccgaacgtaaaagtacatctggacacctatcacatgaatattgaagaatccgattttatgcaacctgtattagcgtgtggggaacgccttggttacgttcatattggagagagccaccgtgggtatcttgggagtggaacgattgactttgcacaatttttccatgcgttagcgatgattggttatcagggtgtaattacctttgagagcttcagtagtgcagtcgtcaatcatgacttatcaaatgccctagcgatttggcgcaacttatgggatgatggaatggatctagccaaacatgctcgtcgttttatggcagacggattagcgagcgcacaacaagctcgtgcttgataacccggg

SEQ ID NO: 8 - protein, 289 aa, Artificial Sequence
  Synthetic
MNPLGIHALVWAGDLSPASTRKVIEQTKRAGYDLVELSLHGPRVMDIALTRDLLQEHGLQIACSRGLSFDADVSSEDPEVVARGVALLEEGVTITAELGGKYFGGVLYGALAKYPRPVTAQGRRNAVESLKRIADFAAEKGVTLGLEVVNRYESNLLNTASQALEMIDEVGQPNVKVHLDTYHMNIEESDFMQPVLACGERLGYVHIGESHRGYLGSGTIDFAQFFHALAMIGYQGVITFESFSSAVVNHDLSNALAIWRNLWDDGMDLAKHARRFMADGLASAQQARA

SEQ ID NO: 9 - DNA, 885 bp, Artificial Sequence
  Synthetic
ggatccatgaacccattaggaattcacgcattagtctgggccggagatttatcaccagcgtctacaagaaaagccgtagaacgcacgaaagctgccggatacgacttagtagaattgagtttacatgatccgcgtgtattagatgtagcagcaacgcgagatctattagaagaacatggtttacaagtcgcgtgctctcgtggtttgtcctttgatgccgatgtcagttccgaagatcccgaagttgttgcgaggggtgaggcattattagaggaaagcctgcgggtaactcatgaactcggtggaaaatatttttgtggagtcctctatagcgcgttgggtaaatacccgaggccagtaacggctcggggtcgccgtaacgctgtcgaatctctaaaacgcgttgcggacagagcggccgagttaggaatcactttgggactagaagtcgtgaatcgctatgagtctaatgtcgttaatactgcacgtcaagcgctggaattaattgatgaggtcggccagccgaacgtaaaggtacatctggacacctatcacatgaatattgaagagagtgatttcatgcaacctgtattagcgtgtggtgaccgtcttggttacgtccatattggagagagtcaccgtgggtatcttgggagcggacatattgactttgcagcctttttccatgcgttagcggatattggttatcagggtccgattacctttgagagcttcagtagtgcagtcgtatcaccgggattatcaaatgcactggcgatttggcgcaacttatgggatgatggaatggatctagccgcccatgctcgtcgttttatggcagacgggttagcgagcgcacaacaagcccgtgcgtgataacccggg

SEQ ID NO: 10 - protein, 289 aa, Artificial Sequence
  Synthetic
MNPLGIHALVWAGDLSPASTRKAVERTKAAGYDLVELSLHDPRVLDVAATRDLLEEHGLQVACSRGLSFDADVSSEDPEVVARGEALLEESLRVTHELGGKYFCGVLYSALGKYPRPVTARGRRNAVESLKRVADRAAELGITLGLEVVNRYESNVVNTARQALELIDEVGQPNVKVHLDTYHMNIEESDFMQPVLACGDRLGYVHIGESHRGYLGSGHIDFAAFFHALADIGYQGPITFESFSSAVVSPGLSNALAIWRNLWDDGMDLAAHARRFMADGLASAQQARA

SEQ ID NO: 11 - DNA, 885 bp, Artificial Sequence
  Synthetic
ggatccatgaacccacttggaattcacgcattagtctgggccggagatttatcaccagcgagcacgcgcagagcagtagcccgcacaaaagaggccggatacgacttagttgaaattagtttacatgatccgcgttcattagatgtagcagcaactcgacgtctattagaggaacatggtttacaagtcgcttgctcccgtggtttgtcttttgatgccgatgtcagttccgaggaccccgaagttgttgcgaggggagaggcattattagaagaagcgttagatgtaactcatgaactcggtggaacgtatttttgtggtgtactctatagcgcgttggggaaatacccacgtccggccacggcgcgcggtagagcgaacgcagtcgaggccttacggcgcgtagcggatcgtgcggctgagctgggagtaactttgggactagaagtcgtgaaccgctatgagactaatgtcgtcaatacggcacggcaagcgctggaattaattgatgaaatcggccaggacaacgtaaaagtacatctggacacctatcacatgaatattgaagaatctgatttcatgcaacctgtaagagcgtgtggtgatcgtcttggttacgttcatattggagagtctcaccgtgggtatcttgggtccggacatattgactttgcagcctttttccatgcgttagcggacattggttatcagggtccgattacctttgagagcttcagtagtgcagtcgtcagtccgggactctcaaatgcactagcgatttggcgcaatctgtgggatgatggaatggatctagccgcgcatgctcgtgcctttatggcagacggattagcgagcgcacaacaagctagggcttgataacccggg

SEQ ID NO: 12 - protein, 289 aa, Artificial Sequence
  Synthetic
MNPLGIHALVWAGDLSPASTRRAVARTKEAGYDLVEISLHDPRSLDVAATRRLLEEHGLQVACSRGLSFDADVSSEDPEVVARGEALLEEALDVTHELGGTYFCGVLYSALGKYPRPATARGRANAVEALRRVADRAAELGVTLGLEVVNRYETNVVNTARQALELIDEIGQDNVKVHLDTYHMNIEESDFMQPVRACGDRLGYVHIGESHRGYLGSGHIDFAAFFHALADIGYQGPITFESFSSAVVSPGLSNALAIWRNLWDDGMDLAAHARAFMADGLASAQQARA

SEQ ID NO: 13 - DNA, 909 bp, Artificial Sequence
  Synthetic
ggatccatgaataaattgggagtacatgcattagtttgggaagcggggtggagcagagatgagtgcgctagagccattgcgcgtaccgcggaaacgggatttgacttcattgaagtaccggcattggacccggcctcaattgatgcggaatttacacgccgtgaactagagcgtcatggattgggagtaaccttcagtttagggttagatgcacaaactgacatcagcagcggtgacccagaaagggctgcacgcggaaaagccaaactagatgatgtattacgcgtagcgcgtgattgtggtgcaactcatgtctgtggaattctctattctgcctttcagaaaaatgccgttccgacaacgcgtgcgggagtagccatggcagcggacattttaggacaagtcgcagatactgcagcgcaatatggcattacgctgggactagaagtcgtaaatcggtatgagagtaatgtcttaaacaccgcttctcagggtgtggaattatgtgagcggattggtccgcccaacgtcaaggtccatttagatacctaccacatgaacattgaagagagtgatatcatgtccgcaattcgagatactggtgatcgcttaggttactttcatattggtgattcacatcgtggttacttaggtagcggaaatgtagatttcactgcggtgttcagagcgttagtcttttcaggttatacgggaccgattacgtttgagtctttttcttccagggtagtcgggcaacctttagagggaattcttgctatttggcgcaacctttgggaagatagtcgtgacttagcgtcgcacgcgctggcctatactcgcgttcagctgaaaagtgcgcaagaggcactcaaacaagccgagcgttcccgtttaccatgataacccggg

SEQ ID NO: 14 - protein, 297 aa, Artificial Sequence
  Synthetic
MNKLGVHALVWEAGWSRDECARAIARTAETGFDFIEVPALDPASIDAEFTRRELERHGLGVTFSLGLDAQTDISSGDPERAARGKAKLDDVLRVARDCGATHVCGILYSAFQKNAVPTTRAGVAMAADILGQVADTAAQYGITLGLEVVNRYESNVLNTASQGVELCERIGPPNVKVHLDTYHMNIEESDIMSAIRDTGDRLGYFHIGDSHRGYLGSGNVDFTAVFRALVFSGYTGPITFESFSSRVVGQPLEGILAIWRNLWEDSRDLASHALAYTRVQLKSAQEALKQAERSRLP

SEQ ID NO: 15 - DNA, 909 bp, Artificial Sequence
  Synthetic
ggatccatgaataaattgggagtacacgcgttagtatgggaagcgggatggtcacgtgatgaatgtgcgcgtgcgattgcgcgcacagcagagactggatttgacttcattgaagtccctgcattagatccggcaagtattgatgtcgattttacgcgtcgagagttagaaaaacatgggctgggagtaactttttctcttggattagatgcggaaactgatatttcttccggggacccggagaaagccgctcgtggaaaagcgaaattggaagatgcgttacgtgtagcacgcgattgtggagccacccacatgtgcggaattctttatagtgcgttccaaaaatacgccgtcccgcccacggcagcgggaatcgcgatgtctgtcgacattttgggtcaggtagctgagactgccgcgcagagtggtgttacattaggactcgaagttgtaaatcgttatgagagtaacgtactcaatacggcctctcagggtgtcgagctatgtaagcgcattggaccaccaaacgtaaaagtgcatttagatacgtaccacatgaatatcgaagagagtgacattgccaccgcaattcgggaaactggtgactatttaggttatttccataccggtgatagccatcgcgggtatctaggttcgggatcaattgatttcagcgcaatctttagagcattagtatttagcggctacaaaggtccgattacttttgaatcattttcatcccgggttgtcggtcaaccattagagggaattctgggaatttggcgcaacttatgggaagattccagggacctggcttctcatgcattaatgtatacccgtgtccaactaaaaagtgcccaagaggctctaaaacaagcggagagaagccgtttaccgtgataacccggg

SEQ ID NO: 16 - protein, 297 aa, Artificial Sequence
  Synthetic
MNKLGVHALVWEAGWSRDECARAIARTAETGFDFIEVPALDPASIDVDFTRRELEKHGLGVTFSLGLDAETDISSGDPEKAARGKAKLEDALRVARDCGATHMCGILYSAFQKYAVPPTAAGIAMSVDILGQVAETAAQSGVTLGLEVVNRYESNVLNTASQGVELCKRIGPPNVKVHLDTYHMNIEESDIATAIRETGDYLGYFHTGDSHRGYLGSGSIDFSAIFRALVFSGYKGPITFESFSSRVVGQPLEGILGIWRNLWEDSRDLASHALMYTRVQLKSAQEALKQAERSRLP

SEQ ID NO: 17 - DNA, 909 bp, Artificial Sequence
  Synthetic
ggatccatgaataagttaggggtacatgcattagtttgggaagcgggatggtcacgtgatgagtgcgcacgtgcgattgctcgtacggcagaaactggtttcgacttgattgaagttcctgcgatggatcccgcatctattgatgtagcatttaccaggcgcgaattggagaaacatggtttaggggtcacctttagctttggattagacgctgaaacagatatttctagtggtgatccggaaaaagtcgcacgcggagaggccaaacttgaagatgcattagcggttgcgcgtgacgtcggtgccacccacatgtgtggaatcttatactccgcgttccagaaatacgctgtaccgccaacagcggatggaattgcccatagcgtagatatcctccgtcgcgtagcagagaaagccgctgcgagtggagtgacgttaggattagaagtcgtcaacagatatgaaagtaatgtactgaacactgccgcccagggtgtcgagatgtgtaaacggattggaccaccgaatgtaaaagtacatttagatacgtatcacatgaatattgaagagtccgacattgcccaagcgattcgcgagactggagactacctaggttatttccatactggagacagtcatcgtgggtatttaggttcaggttctattgattttgcggcaatctttcgtgcattggttagcagcggttataaaggcccaattacgtttgaatctttttcgagtcgggtcgtgggtcaaccgttagagggaattctgggaatttggcgcaacctctgggaagatagtcgtgatcttgctgcgcacgcactaatgtatactagggtacagctgaaatccgcgcaagaggccctaaaacaagccgagagatcacgcttaccgtgataacccggg

SEQ ID NO: 18 - protein, 297 aa, Artificial Sequence
  Synthetic
MNKLGVHALVWEAGWSRDECARAIARTAETGFDLIEVPAMDPASIDVAFTRRELEKHGLGVTFSFGLDAETDISSGDPEKVARGEAKLEDALAVARDVGATHMCGILYSAFQKYAVPPTADGIAHSVDILRRVAEKAAASGVTLGLEVVNRYESNVLNTAAQGVEMCKRIGPPNVKVHLDTYHMNIEESDIAQAIRETGDYLGYFHTGDSHRGYLGSGSIDFAAIFRALVSSGYKGPITFESFSSRVVGQPLEGILGIWRNLWEDSRDLAAHALMYTRVQLKSAQEALKQAERSRLP

SEQ ID NO: 19 - DNA, 909 bp, Artificial Sequence
  Synthetic
ggatccatgaataagttaggggtacatgcgttagtctgggaagcgggttggagtagagatgagtgtgcacgtgccattgctaggactgccgaaacgggatacgacttaattgaagtaccagcgatggatccggcgagttttgatgtcgcatttacccgtagagagttggagaaacatggactcggagtaaccatgtcctttggtttatctgcggatacagatatttctagcggggatccggagcgtgtcgcacgcggagaagcaaaacttgaagatgctctgtcagtcgcgcgtgatgttggtgcgacgcacatgtgtggtattctttattccgcgtttcagaaatatgccactccagcaacggcagacggaattgcgaactctgtagaagtattacgtcgtgtcgccgagaaagccgctgccagtggcattacattaggactcgaagttgtaaatcggtatgagagtaacgtcctgaataccgccgctcaagctgtcgaaatggtcaaacgtatcggaccgcctaacgtaaaagtacatttagacacttaccacatgaatatcgaagagagtgacattgcgcaggcaattcgtgagactggtgattatctaggttatttccacacgggtgacagtcatcgcggatatctaggttcaggatcaattgattttgcggcaattttccgcgcactagtctcgattggatacaaagggccgatcactttcgagagcttttccagcgcagttgtgggacaacccttagagggaattttgggtatttggcgcaacttatgggaagattctcgtgatttagccgcacatgcacgggcgtatactcgcgtacaactgaaaagcgcgcaagaggccttaaaacaagcggaaaggtcacgcttaccgtgataacccggg

SEQ ID NO: 20 - protein, 297 aa, Artificial Sequence
  Synthetic
MNKLGVHALVWEAGWSRDECARAIARTAETGYDLIEVPAMDPASFDVAFTRRELEKHGLGVTMSFGLSADTDISSGDPERVARGEAKLEDALSVARDVGATHMCGILYSAFQKYATPATADGIANSVEVLRRVAEKAAASGITLGLEVVNRYESNVLNTAAQAVEMVKRIGPPNVKVHLDTYHMNIEESDIAQAIRETGDYLGYFHTGDSHRGYLGSGSIDFAAIFRALVSIGYKGPITFESFSSAVVGQPLEGILGIWRNLWEDSRDLAAHARAYTRVQLKSAQEALKQAERSRLP

SEQ ID NO: 21 - DNA, 909 bp, Artificial Sequence
  Synthetic
ggatccatgaataaactgggagtacacgcattggtatgggaagctggatggtcacgggatgaatgtgctcgcgcgattgcccgtaccgcagaggccggatacgacttaattgagattccggcgttggacccagcatcattcgatgtcgcgtttacgcgtcgtcagttagaggaacatgggttacaagttaccgtcagtttaggattatctgcagacgcggacattagctccgaggatcctgaagttgtagcgcgtggagaagcaatgctcgaagatgccttagatgtcaccagggacattggtggaactcacatgtgtggtattctttatagcgcgttaggaaagtatcccagaccggcgacggcacagggaattgcgaacagtgtagaagtcttacgccgggttgcagagaaagccgctgcctctggtatcactttaggtttagaagtcgtgaatcgctacgaaacaaacgtcctcaacacagcagcgcaggccctagagatgattaaagaaatcggaccggataatgtcaaagtacatttagatacttatcacatgaacattgaggaaagcgatctagcccaagcaattcgagcgtgcggggatcgtttaggttatttccatattggtgagtctcatcgcggttatctgggtacgggtagtattgattttgcagcgatttttcgtgcgctggcagagatcggatacaatgggccgattacgtttgagtcgttttcctctgccgtcgtatccccggacttgagtggaattttaggtatttggcgtaatctttgggaagatagtcgcgatttagctagacatgcgagggcctatactcgcgtacaactaaaaagcgctcaagaagcactaaaacaagcggagcgttcacgtttaccatgataacccggg

SEQ ID NO: 22 - protein, 297 aa, Artificial Sequence
  Synthetic
MNKLGVHALVWEAGWSRDECARAIARTAEAGYDLIEIPALDPASFDVAFTRRQLEEHGLQVTVSLGLSADADISSEDPEVVARGEAMLEDALDVTRDIGGTHMCGILYSALGKYPRPATAQGIANSVEVLRRVAEKAAASGITLGLEVVNRYETNVLNTAAQALEMIKEIGPDNVKVHLDTYHMNIEESDLAQAIRACGDRLGYFHIGESHRGYLGTGSIDFAAIFRALAEIGYNGPITFESFSSAVVSPDLSGILGIWRNLWEDSRDLARHARAYTRVQLKSAQEALKQAERSRLP

SEQ ID NO: 23 - DNA, 909 bp, Artificial Sequence
  Synthetic
ggatccatgaataagttaggtgtacatgcattagtttgggaggcgggttggagtcgtgatgaatgtgctagagccattgcacgtaccgccgaggccggttatgatctcattgaaattccggcgttagatcccgcctccttcgatgtcgcagcaactcgtcgcttattagaggaacatggattacaagttacggtgtcattgggacttagtgcggatgccgacattagctccgaggatccagaagtcgtcgctcgtggggaagccatgttagacgatgctttagacgtaacgcgcgatattgggggaacccacatgtgtggaattttgtatagtgcactgggtaaatacccgaggccggcaactgcgcgtggtcgggcgaattccgtagaggcactacgtcgtgtcgcggatcgggctgcggccagtggaatcacgctaggtttagaagtcgtaaacagatatgaaacgaacgtcttaaacactgcggcacaggcattggaattcattgaagagatcggaccggataatgtaaaagtacatctcgatacatatcacatgaatattgaagagtctgacttagctcaagcaattagagcgtgcggcgataggttaggttatgtacatattggtgagtcacatcgtggatacctgggaactggttcaatcgattttgccgcgatttttcgcgcattagctgagattgggtacgatggaccaattacctttgagtcttttagttctgcggttgtctctcctgacttaagcggaattctggcgatttggcgcaatctatgggacgacagtcgcgatttagcacgccatgcccgagcgtatacacgtgtacagcttaaaagcgcgcaagaagcgctaaaacaagccgagcgctcgcgtttaccgtgataacccggg

SEQ ID NO: 24 - protein, 297 aa, Artificial Sequence
  Synthetic
MNKLGVHALVWEAGWSRDECARAIARTAEAGYDLIEIPALDPASFDVAATRRLLEEHGLQVTVSLGLSADADISSEDPEVVARGEAMLDDALDVTRDIGGTHMCGILYSALGKYPRPATARGRANSVEALRRVADRAAASGITLGLEVVNRYETNVLNTAAQALEFIEEIGPDNVKVHLDTYHMNIEESDLAQAIRACGDRLGYVHIGESHRGYLGTGSIDFAAIFRALAEIGYDGPITFESFSSAVVSPDLSGILAIWRNLWDDSRDLARHARAYTRVQLKSAQEALKQAERSRLP

SEQ ID NO: 25 - DNA, 891 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (51)..(51): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (390)..(390): n is a, c, g, or t
  misc_feature (393)..(393): n is a, c, g, or t
  misc_feature (399)..(399): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (579)..(579): n is a, c, g, or t
  misc_feature (582)..(582): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (675)..(675): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (705)..(705): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (831)..(831): n is a, c, g, or t
  misc_feature (834)..(834): n is a, c, g, or t
  misc_feature (837)..(837): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (873)..(873): n is a, c, g, or t
  misc_feature (879)..(879): n is a, c, g, or t
  misc_feature (882)..(882): n is a, c, g, or t
  misc_feature (885)..(885): n is a, c, g, or t
  misc_feature (888)..(888): n is a, c, g, or t
  misc_feature (891)..(891): n is a, c, g, or t
atgaayaarytnggngtncaygcnytngtntgggargcnggntggwsnmgngaygartgygcnmgngcnathgcnmgnacngcngaracnggnttygayttyathgargtnccngcnytngayccngcnwsnathgaygcngarttyacnmgnmgngarytngarmgncayggnytnggngtnacnttywsnytnggnytngaygcncaracngayathwsnwsnggngayccngcnmgngcngcnmgnggnaargcnaarytngaygaygtnytnmgngtngcnmgngaytgyggngcnacncaygtntgyggnathytntaywsngcnttycaraaraaygcngtnccnacnacnmgngcnggngtngcnatggcngcngayathytnggncargtngcngayacngcngcncartayggnathacnytnggnytngargtngtnaaymgntaygarwsnaaygtnytnaayacngcnwsncarggngtngarytntgygarmgnathggnmgnccnaaygtnaargtncayytngayacntaycayatgaayathgargarwsngayathatgwsngcnathmgngayacnggngaymgnytnggntayttycayathggngaywsncaymgnggntayytnggnwsnggnaaygtngayttyacngcngtnttymgngcnytngtnttywsntgytayacnggnccnathacnttygarwsnttywsnwsnmgngtngtnggncarccnytngarggnathytngcnathtggmgnaayytntgggargaywsnwsngayytngcnwsncaygcnytngcntayacnmgngtncarytnaarwsngcncargargcnytnaarcargcngarmgnwsnmgnytnccn

SEQ ID NO: 26 - protein, 297 aa, Burkholderia multivorans ATCC 17616
MNKLGVHALVWEAGWSRDECARAIARTAETGFDFIEVPALDPASIDAEFTRRELERHGLGVTFSLGLDAQTDISSGDPARAARGKAKLDDVLRVARDCGATHVCGILYSAFQKNAVPTTRAGVAMAADILGQVADTAAQYGITLGLEVVNRYESNVLNTASQGVELCERIGRPNVKVHLDTYHMNIEESDIMSAIRDTGDRLGYFHIGDSHRGYLGSGNVDFTAVFRALVFSCYTGPITFESFSSRVVGQPLEGILAIWRNLWEDSSDLASHALAYTRVQLKSAQEALKQAERSRLP

SEQ ID NO: 27 - DNA, 891 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (51)..(51): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (390)..(390): n is a, c, g, or t
  misc_feature (393)..(393): n is a, c, g, or t
  misc_feature (399)..(399): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (579)..(579): n is a, c, g, or t
  misc_feature (582)..(582): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (606)..(606): n is a, c, g, or t
  misc_feature (609)..(609): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (675)..(675): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (699)..(699): n is a, c, g, or t
  misc_feature (705)..(705): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (831)..(831): n is a, c, g, or t
  misc_feature (834)..(834): n is a, c, g, or t
  misc_feature (837)..(837): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (873)..(873): n is a, c, g, or t
  misc_feature (879)..(879): n is a, c, g, or t
  misc_feature (882)..(882): n is a, c, g, or t
  misc_feature (885)..(885): n is a, c, g, or t
  misc_feature (888)..(888): n is a, c, g, or t
  misc_feature (891)..(891): n is a, c, g, or t
atgaayaarytnggngtncaygcnytngtntgggargcnggntggwsnmgngaygartgygcnmgngcnathgcnwsnacngcngaracnggnttygayttyathgargtnccngcnytngayccngcnwsnathgayacngarttyacnmgnmgngarytngarmgncayggnytnggngtnacnttywsnytnggnytngaygcncaracngayathwsnwsnggngayccngcnmgngcngcnmgnggnaargcnaarytngaygaygtnytnmgngtngcnmgngaytgyggngcnacncaygtntgyggnathytntaywsngcnttycaraaraaygcngtnccnacnacnmgnacnggngtngcnatggcngcngayathytnggncargtngcngayacngcngcncartayggnathacnytnggnytngargtngtnaaymgntaygarwsnaaygtnytnaayacngcnwsncarggngtngarytntgygaymgnathggnmgnccnaaygtnaargtncayytngayacntaycayatgaayathgargarwsngayathatgwsngcnathmgngayacnggngarcayytnggntayttycayathggngaywsncaymgnggntayytnggnwsnggnaaygtngayttyacngcngtnttymgngcnytngtnttywsnggntayacnggnccnathacnttygarwsnttywsnwsnmgngtngtnggncarccnytngarggnathytngcnathtggmgnaayytntgggargaywsnmgngayytngcnwsncaygcnytngcntayacnmgngtncarytnaarwsngcncargargcnytnaarcargcngarmgnwsnmgnytnccn

SEQ ID NO: 28 - protein, 297 aa, Burkholderia ubonensis
MNKLGVHALVWEAGWSRDECARAIASTAETGFDFIEVPALDPASIDTEFTRRELERHGLGVTFSLGLDAQTDISSGDPARAARGKAKLDDVLRVARDCGATHVCGILYSAFQKNAVPTTRTGVAMAADILGQVADTAAQYGITLGLEVVNRYESNVLNTASQGVELCDRIGRPNVKVHLDTYHMNIEESDIMSAIRDTGEHLGYFHIGDSHRGYLGSGNVDFTAVFRALVFSGYTGPITFESFSSRVVGQPLEGILAIWRNLWEDSRDLASHALAYTRVQLKSAQEALKQAERSRLP

SEQ ID NO: 29 - DNA, 891 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (51)..(51): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (390)..(390): n is a, c, g, or t
  misc_feature (393)..(393): n is a, c, g, or t
  misc_feature (399)..(399): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (579)..(579): n is a, c, g, or t
  misc_feature (582)..(582): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (675)..(675): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (699)..(699): n is a, c, g, or t
  misc_feature (705)..(705): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (831)..(831): n is a, c, g, or t
  misc_feature (834)..(834): n is a, c, g, or t
  misc_feature (837)..(837): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (873)..(873): n is a, c, g, or t
  misc_feature (879)..(879): n is a, c, g, or t
  misc_feature (882)..(882): n is a, c, g, or t
  misc_feature (885)..(885): n is a, c, g, or t
  misc_feature (888)..(888): n is a, c, g, or t
  misc_feature (891)..(891): n is a, c, g, or t
atgaayaarytnggngtncaygcnytngtntgggargcnggntggwsnmgngaygartgygcnmgngcnathgcnmgnacngcngaracnggnttygayttyathgargtnccngcnytngayccngcnwsnathgaygcngarttyacnmgnmgngarytngarmgncayggnytnggngtnacnttywsnytnggnytngaygcncaracngayathwsnwsnggngayccngtnmgngcngcnmgnggnaargcnaarytngaygaygtnytnmgngtngcnmgngaytgyggngcnacncaygtntgyggnathytntaywsngcnttycaraaraaygcngtnccnacnacnmgngcnggngtngcnatggcngcngayathytnggncargtngcngayacngcngcncartayggnathacnytnggnytngargtngtnaaymgntaygarwsnaaygtnytnaayacngcnwsncarggngtngarytntgygarmgnathggnmgnccnaaygtnaargtncayytngayacntaycayatgaayathgargarwsngayathatgwsngcnathmgngayacnggngaymgnytnggntayttycayathggngaywsncaymgnggntayytnggnwsnggnaaygtngayttyacngcngtnttymgngcnytngtnttywsnggntayacnggnccnathacnttygarwsnttywsnwsnmgngtngtnggncarccnytngarggnathytngcnathtggmgnaayytntgggargaywsnmgngayytngcnwsncaygcnytngcntayacnmgngtncarytnaarwsngcncargargcnytnaarcargcngarmgnwsnmgnytnccn

SEQ ID NO: 30 - protein, 297 aa, Burkholderia multivorans
MNKLGVHALVWEAGWSRDECARAIARTAETGFDFIEVPALDPASIDAEFTRRELERHGLGVTFSLGLDAQTDISSGDPVRAARGKAKLDDVLRVARDCGATHVCGILYSAFQKNAVPTTRAGVAMAADILGQVADTAAQYGITLGLEVVNRYESNVLNTASQGVELCERIGRPNVKVHLDTYHMNIEESDIMSAIRDTGDRLGYFHIGDSHRGYLGSGNVDFTAVFRALVFSGYTGPITFESFSSRVVGQPLEGILAIWRNLWEDSRDLASHALAYTRVQLKSAQEALKQAERSRLP

SEQ ID NO: 31 - DNA, 891 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (51)..(51): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (390)..(390): n is a, c, g, or t
  misc_feature (393)..(393): n is a, c, g, or t
  misc_feature (399)..(399): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (579)..(579): n is a, c, g, or t
  misc_feature (582)..(582): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (675)..(675): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (699)..(699): n is a, c, g, or t
  misc_feature (705)..(705): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (831)..(831): n is a, c, g, or t
  misc_feature (834)..(834): n is a, c, g, or t
  misc_feature (837)..(837): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (873)..(873): n is a, c, g, or t
  misc_feature (879)..(879): n is a, c, g, or t
  misc_feature (882)..(882): n is a, c, g, or t
  misc_feature (885)..(885): n is a, c, g, or t
  misc_feature (888)..(888): n is a, c, g, or t
  misc_feature (891)..(891): n is a, c, g, or t
atgaayaarytnggngtncaygcnytngtntgggargcnggntggwsnmgngaygartgygcnmgngcnathgcnmgnacngcngaracnggnttygayttyathgargtnccngcnytngayccngcnwsnathgaygcngarttyacnmgnmgngarytngarmgncayggnytnggngtnacnttywsnytnggnytngaygcncaracngayathwsnwsnggngayccngcnmgngcngcnmgnggnaargcnaarytngaygaygtnytnmgngtngcnmgngaytgyggngcnacncaygtntgyggnathytntaywsngcnttycaraaraaygcngtnccnacnacnmgngcnggngtngcnatggcngcngayathytnggncargtngcngayacngcngcncartayggnathacnytnggnytngargtngtnaaymgntaygarwsnaaygtnytnaayacngcnwsncarggngtngarytntgygarmgnathggnmgnccnaaygtnaargtncayytngayacntaycayatgaayathgargarwsngayathatgwsngcnathmgngayacnggngaymgnytnggntayttycayathggngaywsncaymgnggntayytnggnwsnggnaaygtngayttyacngcngtnttymgngcnytngtnttywsnggntayacnggnccnathacnttygarwsnttywsnwsnmgngtngtnggncarccnytngarggnathytngcnathtggmgnaayytntgggargaywsnmgngayytngcnwsncaygcnytngcntayacnmgngtncarytnaarwsngcncargargcnytnaarcargcngarmgnwsnmgnytnccn

SEQ ID NO: 32 - protein, 297 aa, Burkholderia multivorans
MNKLGVHALVWEAGWSRDECARAIARTAETGFDFIEVPALDPASIDAEFTRRELERHGLGVTFSLGLDAQTDISSGDPARAARGKAKLDDVLRVARDCGATHVCGILYSAFQKNAVPTTRAGVAMAADILGQVADTAAQYGITLGLEVVNRYESNVLNTASQGVELCERIGRPNVKVHLDTYHMNIEESDIMSAIRDTGDRLGYFHIGDSHRGYLGSGNVDFTAVFRALVFSGYTGPITFESFSSRVVGQPLEGILAIWRNLWEDSRDLASHALAYTRVQLKSAQEALKQAERSRLP

SEQ ID NO: 33 - DNA, 891 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (51)..(51): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (234)..(234): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (390)..(390): n is a, c, g, or t
  misc_feature (393)..(393): n is a, c, g, or t
  misc_feature (399)..(399): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (579)..(579): n is a, c, g, or t
  misc_feature (582)..(582): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (675)..(675): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (699)..(699): n is a, c, g, or t
  misc_feature (705)..(705): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (831)..(831): n is a, c, g, or t
  misc_feature (834)..(834): n is a, c, g, or t
  misc_feature (837)..(837): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (873)..(873): n is a, c, g, or t
  misc_feature (879)..(879): n is a, c, g, or t
  misc_feature (882)..(882): n is a, c, g, or t
  misc_feature (885)..(885): n is a, c, g, or t
  misc_feature (888)..(888): n is a, c, g, or t
  misc_feature (891)..(891): n is a, c, g, or t
atgaayaarytnggngtncaygcnytngtntgggargcnggntggwsnmgngaygartgygcnmgngcnathgcnmgnacngcngaracnggnttygayttyathgargtnccngcnytngayccngcnwsnathgaygcngarttyacnmgnmgngarytngarmgncayggnytnggngtnacnttywsnytnggnytngaygcncaracngayathwsnwsnggngayccngarmgngcngcnmgnggnaargcnaarytngaygaygtnytnmgngtngcnmgngaytgyggngcnacncaygtntgyggnathytntaywsngcnttycaraaraaygcngtnccnacnacnmgngcnggngtngcnatggcngcngayathytnggncargtngcngayacngcngcncartayggnathacnytnggnytngargtngtnaaymgntaygarwsnaaygtnytnaayacngcnwsncarggngtngarytntgygarmgnathggnmgnccnaaygtnaargtncayytngayacntaycayatgaayathgargarwsngayathatgwsngcnathmgngayacnggngaymgnytnggntayttycayathggngaywsncaymgnggntayytnggnwsnggnaaygtngayttyacngcngtnttymgngcnytngtnttywsnggntayacnggnccnathacnttygarwsnttywsnwsnmgngtngtnggncarccnytngarggnathytngcnathtggmgnaayytntgggargaywsnmgngayytngcnwsncaygcnytngcntayacnmgngtncarytnaarwsngcncargargcnytnaarcargcngarmgnwsnmgnytnccn

SEQ ID NO: 34 - protein, 297 aa, Burkholderia multivorans CGD1
MNKLGVHALVWEAGWSRDECARAIARTAETGFDFIEVPALDPASIDAEFTRRELERHGLGVTFSLGLDAQTDISSGDPERAARGKAKLDDVLRVARDCGATHVCGILYSAFQKNAVPTTRAGVAMAADILGQVADTAAQYGITLGLEVVNRYESNVLNTASQGVELCERIGRPNVKVHLDTYHMNIEESDIMSAIRDTGDRLGYFHIGDSHRGYLGSGNVDFTAVFRALVFSGYTGPITFESFSSRVVGQPLEGILAIWRNLWEDSRDLASHALAYTRVQLKSAQEALKQAERSRLP

SEQ ID NO: 35 - DNA, 891 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (57)..(57): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (234)..(234): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (270)..(270): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (390)..(390): n is a, c, g, or t
  misc_feature (393)..(393): n is a, c, g, or t
  misc_feature (399)..(399): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (606)..(606): n is a, c, g, or t
  misc_feature (609)..(609): n is a, c, g, or t
  misc_feature (621)..(621): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (831)..(831): n is a, c, g, or t
  misc_feature (834)..(834): n is a, c, g, or t
  misc_feature (837)..(837): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (873)..(873): n is a, c, g, or t
  misc_feature (879)..(879): n is a, c, g, or t
  misc_feature (882)..(882): n is a, c, g, or t
  misc_feature (885)..(885): n is a, c, g, or t
  misc_feature (888)..(888): n is a, c, g, or t
  misc_feature (891)..(891): n is a, c, g, or t
atgaayaarytnggngtncaygcnytngtntgggargcnwsntggwsncaygargcntgygcnmgngcnathgcnmgnacngcngargtnggnttygayttyathgargtnccngcnytngayccnacnwsnathgaygtngayttyacnmgnmgngarytngaraaraayggnytnggngtnacnttywsnytnggnytngaygcngarwsngayathwsnwsnggngaygtngaraargcngcnmgnggnaargcnaarytngaracngcnytnmgngtngcnmgngaytgyggngcnacncayatgtgyggnathytntaywsngcnttycaraartaytaygtnccnccnacngcngcnggnathgcnatgwsngtngayathytnggngargtngcncaracngcngcnaarwsnggngtngtnytnggnytngargtngtnaaymgntaygarwsnaaygtnytnaayacngcnwsncarggngtngarytntgyaarmgnathggngcnccnaaygtnaargtncayytngayacntaycayatgaayathgargarwsngayathgcnacngcngtnmgngaracnggngaytayytnggntayttycayacnggngaywsncaymgnggntayytnggnwsnggnwsnathgayttywsngarathttymgngcnytngtnttywsnggnttyaarggnccnathacnttygarwsnttywsnwsnmgngtngtnggncarccnytngarggnathytnggnathtggmgnaayytntgggargayggncaygayytngcnwsncaygcnytnatgtayacnmgngcncarathaargcngcncargargcnytnaarcargcngarmgnwsnmgnytnwsn

SEQ ID NO: 36 - protein, 297 aa, Burkholderia acidipaludis
MNKLGVHALVWEASWSHEACARAIARTAEVGFDFIEVPALDPTSIDVDFTRRELEKNGLGVTFSLGLDAESDISSGDVEKAARGKAKLETALRVARDCGATHMCGILYSAFQKYYVPPTAAGIAMSVDILGEVAQTAAKSGVVLGLEVVNRYESNVLNTASQGVELCKRIGAPNVKVHLDTYHMNIEESDIATAVRETGDYLGYFHTGDSHRGYLGSGSIDFSEIFRALVFSGFKGPITFESFSSRVVGQPLEGILGIWRNLWEDGHDLASHALMYTRAQIKAAQEALKQAERSRLS

SEQ ID NO: 37 - DNA, 894 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (30)..(30): n is a, c, g, or t
  misc_feature (42)..(42): n is a, c, g, or t
  misc_feature (51)..(51): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (141)..(141): n is a, c, g, or t
  misc_feature (144)..(144): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (186)..(186): n is a, c, g, or t
  misc_feature (192)..(192): n is a, c, g, or t
  misc_feature (198)..(198): n is a, c, g, or t
  misc_feature (204)..(204): n is a, c, g, or t
  misc_feature (207)..(207): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (270)..(270): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (411)..(411): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (426)..(426): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (576)..(576): n is a, c, g, or t
  misc_feature (582)..(582): n is a, c, g, or t
  misc_feature (594)..(594): n is a, c, g, or t
  misc_feature (597)..(597): n is a, c, g, or t
  misc_feature (606)..(606): n is a, c, g, or t
  misc_feature (609)..(609): n is a, c, g, or t
  misc_feature (621)..(621): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (666)..(666): n is a, c, g, or t
  misc_feature (669)..(669): n is a, c, g, or t
  misc_feature (672)..(672): n is a, c, g, or t
  misc_feature (675)..(675): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (831)..(831): n is a, c, g, or t
  misc_feature (837)..(837): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (876)..(876): n is a, c, g, or t
  misc_feature (879)..(879): n is a, c, g, or t
  misc_feature (882)..(882): n is a, c, g, or t
  misc_feature (885)..(885): n is a, c, g, or t
  misc_feature (888)..(888): n is a, c, g, or t
  misc_feature (891)..(891): n is a, c, g, or t
  misc_feature (894)..(894): n is a, c, g, or t
atgaayaarytnggngtncaygcnttygtntgggaraarggntggaaymgngargarwsnacnmgngcnathgcnmgnwsngcngcnacnggntaygayytnathgargtnwsngcnatggayatgaaygarathgayccngcncayacnmgngcngarytngayaartayggnytnggntgyacnttywsnttyggnatgggngcngargargayathwsnwsnaaygayccngayaaratgaarmgnggngargcnaarytngarmgngcngtngcnytngcnmgngayytnggngcnacncayathgcnggnathytntaywsngcnttycaraartaygcngtnccnccnacngcngayggngtnwsncaywsngtngayathytnmgnmgngtngcngaraargcngcngcnwsnaaygtnathatgggnytngargtngtnaaymgntaygaracnaaygtnytnaayacngcngcncarggngtngaratgtgyaarmgnathggngcnccnaaygtnaargtncayytngaygtntaycayatgaayathgargarwsngayathwsncargcnathathgaracnggngaytayytnggntayttycayacnggngaywsncaymgnggntayatgggnwsnggnwsnathgayytngcnggngtnttymgngcnytngtnaargcnaaytayaarggnccnathacnttygarwsnttywsnwsnmgngtngtnggncarccnytngarggnathytnggnathtggmgnaayytntgggaygaywsngargayytngcngcncaygcnytnatgtayacnaargcncarytnaarwsngcncargargcncaraaycaraargcnmgnwsnmgnytnccngcn

SEQ ID NO: 38 - protein, 298 aa, Rhizobium sp. AP16
MNKLGVHAFVWEKGWNREESTRAIARSAATGYDLIEVSAMDMNEIDPAHTRAELDKYGLGCTFSFGMGAEEDISSNDPDKMKRGEAKLERAVALARDLGATHIAGILYSAFQKYAVPPTADGVSHSVDILRRVAEKAAASNVIMGLEVVNRYETNVLNTAAQGVEMCKRIGAPNVKVHLDVYHMNIEESDISQAIIETGDYLGYFHTGDSHRGYMGSGSIDLAGVFRALVKANYKGPITFESFSSRVVGQPLEGILGIWRNLWDDSEDLAAHALMYTKAQLKSAQEAQNQKARSRLPA

SEQ ID NO: 39 - DNA, 891 bp, Artificial Sequence; identical to SEQ ID NO: 33
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (51)..(51): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (234)..(234): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (390)..(390): n is a, c, g, or t
  misc_feature (393)..(393): n is a, c, g, or t
  misc_feature (399)..(399): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (579)..(579): n is a, c, g, or t
  misc_feature (582)..(582): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (675)..(675): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (699)..(699): n is a, c, g, or t
  misc_feature (705)..(705): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (831)..(831): n is a, c, g, or t
  misc_feature (834)..(834): n is a, c, g, or t
  misc_feature (837)..(837): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (873)..(873): n is a, c, g, or t
  misc_feature (879)..(879): n is a, c, g, or t
  misc_feature (882)..(882): n is a, c, g, or t
  misc_feature (885)..(885): n is a, c, g, or t
  misc_feature (888)..(888): n is a, c, g, or t
  misc_feature (891)..(891): n is a, c, g, or t

SEQ ID NO: 40 - protein, 298 aa, Agrobacterium radiobacter K84
MNKLGVHAFVWEKGWSREESKRAIARSAATGFDLIEVSAMDMNEIDPAHTRAELDKHGLGCTFSFGMGAEEDISSNDPDKMKRGEAKLERAVALARDLGATHIAGILYSAFQKYAVPPTADGISHSVDILRRVAEKAAASNVIMGLEVVNRYETNVLNTAAQGVEMCKRIGAPNVKVHLDVYHMNIEESDISQAIIETGDYLGYFHTGDSHRGYMGSGSIDLAGVFRALVKANYKGPITFESFSSRVVGQPLEGILGIWRNLWDDSEDLAAHALMYTKAQLKSAQEAQNQKARSRLPA

SEQ ID NO: 41 - DNA, 879 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (51)..(51): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (186)..(186): n is a, c, g, or t
  misc_feature (192)..(192): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (234)..(234): n is a, c, g, or t
  misc_feature (240)..(240): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (267)..(267): n is a, c, g, or t
  misc_feature (273)..(273): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (495)..(495): n is a, c, g, or t
  misc_feature (501)..(501): n is a, c, g, or t
  misc_feature (507)..(507): n is a, c, g, or t
  misc_feature (510)..(510): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (582)..(582): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (621)..(621): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (693)..(693): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (825)..(825): n is a, c, g, or t
  misc_feature (831)..(831): n is a, c, g, or t
  misc_feature (837)..(837): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (870)..(870): n is a, c, g, or t
  misc_feature (879)..(879): n is a, c, g, or t
atgaayaarytnggnytncaygcnttygtntggacngcnggntggacnccngargaygcngcnatggcnathmgnwsnacngcngarytnggntaygayytnathgargcnwsnacnatggayytnaargcnttygaygtnccngcnacnytnmgngarytngargcnaaymgnytnggnathacnatgwsnttyggnytnacngcngayatggayathwsnwsnggngayccngarmgnathmgnmgnggngargcncayytnytngaygcnatgwsnytngcnmgngaygtnggngcnacncaygtntgyggnathytntaywsngcnttycaraartaygcnacnccngtnacngcngayggngtnmgnggnwsnathgargtngtnmgnmgngtngcngaraargcncargcnwsnggnathacnytnggnatggargtngtnaaymgntaygarwsnaaygtnytnaayacngcnmgncargcnathgcntaygtnaarmgngtngaratgccnaaygtnaarytncayytngaytgytaycayatgaayathgargargcngaywsngcngargcnathmgngargcnggngayytnytnggntayttycayacnggngaywsncaymgnggntayytnggnwsnggnwsngtngayttyccnwsnathttymgngcnytngarwsnathcartayaarggnccnathacnttygarwsnttywsnwsngcngtngtnggncarccnytngarggnathytnggnathtggmgnaayytntgggargaywsnmgngayytngcngcncaygcnaargcnttyacngaygtncaratgaarwsngcnmgngargcnytnggnmgncaraarmgn

SEQ ID NO: 42 - protein, 293 aa, Asaia sp. SF2.1
MNKLGLHAFVWTAGWTPEDAAMAIRSTAELGYDLIEASTMDLKAFDVPATLRELEANRLGITMSFGLTADMDISSGDPERIRRGEAHLLDAMSLARDVGATHVCGILYSAFQKYATPVTADGVRGSIEVVRRVAEKAQASGITLGMEVVNRYESNVLNTARQAIAYVKRVEMPNVKLHLDCYHMNIEEADSAEAIREAGDLLGYFHTGDSHRGYLGSGSVDFPSIFRALESIQYKGPITFESFSSAVVGQPLEGILGIWRNLWEDSRDLAAHAKAFTDVQMKSAREALGRQKR

SEQ ID NO: 43 - DNA, 879 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (48)..(48): n is a, c, g, or t
  misc_feature (51)..(51): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (177)..(177): n is a, c, g, or t
  misc_feature (180)..(180): n is a, c, g, or t
  misc_feature (186)..(186): n is a, c, g, or t
  misc_feature (192)..(192): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (240)..(240): n is a, c, g, or t
  misc_feature (243)..(243): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (267)..(267): n is a, c, g, or t
  misc_feature (273)..(273): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (366)..(366): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (381)..(381): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (495)..(495): n is a, c, g, or t
  misc_feature (501)..(501): n is a, c, g, or t
  misc_feature (510)..(510): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (582)..(582): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (621)..(621): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (693)..(693): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (825)..(825): n is a, c, g, or t
  misc_feature (831)..(831): n is a, c, g, or t
  misc_feature (837)..(837): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (870)..(870): n is a, c, g, or t
  misc_feature (876)..(876): n is a, c, g, or t
  misc_feature (879)..(879): n is a, c, g, or t
atgaayaarytnggnytncaygcnttygtntggacngcnaaytggacnccngargaygcngcnatggcnathmgnwsnacngcngarytnggntaygayytnathgargcnwsnacnatggayytnaargcnttygaygtnccngcnacnytnmgngarytngarmgnaayaarytnggnathacnatgwsnttyggnytnacngcngayatggayathwsnwsnggngayaargarmgnacnaarmgnggngargcncayytnytngaygcnatgwsnytngcnmgngaygtnggngcnacncaygtntgyggnathytntaywsngcnttycaraartaygcnacnccngtnacngargayggnathmgnggnwsngtngaygtngtnmgnmgngtngcngaraargcncargcnwsnggnathacnytnggnatggargtngtnaaymgntaygarwsnaaygtnytnaayacngcnmgncargcnathgcntaygtnaaraargtngaratgccnaaygtnaarytncayytngaytgytaycayatgaayathgargargcngaywsngcngargcnathmgngargcnggngayytnytnggntayttycayacnggngaywsncaymgnggntayytnggnwsnggnwsngtngayttyccnwsnathttymgngcnytngarwsnathaaytaycarggnccnathacnttygarwsnttywsnwsngcngtngtnggncarccnytngarggnathytnggnathtggmgnaayytntgggargaywsnmgngayytngcngcncaygcnaargcnttyacngaygtncaratgaarwsngcnmgngargcnytnggnmgncarmgnmgn

SEQ ID NO: 44 - protein, 293 aa, Asaia prunellae
MNKLGLHAFVWTANWTPEDAAMAIRSTAELGYDLIEASTMDLKAFDVPATLRELERNKLGITMSFGLTADMDISSGDKERTKRGEAHLLDAMSLARDVGATHVCGILYSAFQKYATPVTEDGIRGSVDVVRRVAEKAQASGITLGMEVVNRYESNVLNTARQAIAYVKKVEMPNVKLHLDCYHMNIEEADSAEAIREAGDLLGYFHTGDSHRGYLGSGSVDFPSIFRALESINYQGPITFESFSSAVVGQPLEGILGIWRNLWEDSRDLAAHAKAFTDVQMKSAREALGRQRR

SEQ ID NO: 45 - DNA, 879 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (51)..(51): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (177)..(177): n is a, c, g, or t
  misc_feature (180)..(180): n is a, c, g, or t
  misc_feature (186)..(186): n is a, c, g, or t
  misc_feature (192)..(192): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (234)..(234): n is a, c, g, or t
  misc_feature (240)..(240): n is a, c, g, or t
  misc_feature (243)..(243): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (267)..(267): n is a, c, g, or t
  misc_feature (273)..(273): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (387)..(387): n is a, c, g, or t
  misc_feature (393)..(393): n is a, c, g, or t
  misc_feature (399)..(399): n is a, c, g, or t
  misc_feature (402)..(402): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (495)..(495): n is a, c, g, or t
  misc_feature (501)..(501): n is a, c, g, or t
  misc_feature (510)..(510): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (621)..(621): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (693)..(693): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (825)..(825): n is a, c, g, or t
  misc_feature (831)..(831): n is a, c, g, or t
  misc_feature (837)..(837): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (876)..(876): n is a, c, g, or t
  misc_feature (879)..(879): n is a, c, g, or t
atgaayaarytnggnytncaygcnttygtntggacngcnggntggacngcngaygaygcngcnatggcnathmgnwsnacngcngarytnggntaygayytnathgargcnwsnacnatggayytnaarggnttygaygtnccnwsnacnytnmgngarytngarmgnaayaarytnggnathacnatgwsnttyggnytnacnwsngayatggayathwsnwsnggngayccngarmgngtnaarmgnggngargcncayytnytngaygcnathwsnytngcnmgngaygtnggngcnacncaygtntgyggnathytntaywsngcnttycaraartaygcngcnccngtnacnwsngarggnathmgnggnwsnathgaygtnatgmgnaargtngcngaraargcncargcnwsnggnathacnytnggnatggargtngtnaaymgntaygarwsnaaygtnytnaayacngcnmgncargcnathgcntaygtnaaraargtngayatgccnaaygtnaarytncayytngaytgytaycayatgaayathgargargcngaywsngcngcngcnathmgngargcnggngayytnytnggntayttycayacnggngaywsncaymgnggntayytnggnwsnggnwsngtngayttyccnwsnathttymgngcnytngargcnathgaytaycarggnccnathacnttygarwsnttywsnwsngcngtngtnggncarccnytngarggnathytnggnathtggmgnaayytntgggargaywsnmgngayytngcnwsncaygcnaaracnttyacngargtncaratgaarwsngcnmgncargcngtngcncaycarmgnmgn

SEQ ID NO: 46 - protein, 293 aa, Asaia astilbis
MNKLGLHAFVWTAGWTADDAAMAIRSTAELGYDLIEASTMDLKGFDVPSTLRELERNKLGITMSFGLTSDMDISSGDPERVKRGEAHLLDAISLARDVGATHVCGILYSAFQKYAAPVTSEGIRGSIDVMRKVAEKAQASGITLGMEVVNRYESNVLNTARQAIAYVKKVDMPNVKLHLDCYHMNIEEADSAAAIREAGDLLGYFHTGDSHRGYLGSGSVDFPSIFRALEAIDYQGPITFESFSSAVVGQPLEGILGIWRNLWEDSRDLASHAKTFTEVQMKSARQAVAHQRR

SEQ ID NO: 47 - DNA, 879 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (51)..(51): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (177)..(177): n is a, c, g, or t
  misc_feature (180)..(180): n is a, c, g, or t
  misc_feature (186)..(186): n is a, c, g, or t
  misc_feature (192)..(192): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (234)..(234): n is a, c, g, or t
  misc_feature (240)..(240): n is a, c, g, or t
  misc_feature (243)..(243): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (267)..(267): n is a, c, g, or t
  misc_feature (273)..(273): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (495)..(495): n is a, c, g, or t
  misc_feature (501)..(501): n is a, c, g, or t
  misc_feature (510)..(510): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (582)..(582): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (621)..(621): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (675)..(675): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (693)..(693): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (825)..(825): n is a, c, g, or t
  misc_feature (831)..(831): n is a, c, g, or t
  misc_feature (837)..(837): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (870)..(870): n is a, c, g, or t
  misc_feature (879)..(879): n is a, c, g, or t
atgaayaarytnggnytncaygcnttygtntggacngcnggntggacnccngargaygcngcnatggcnathmgnwsnacngcngarytnggntaygayytnathgargcnwsnacnatggayytnaargcnttygaygtnccngcnacnytnmgngarytngarmgnaayaarytnggnathacnatgwsnttyggnytnacnwsngayatggayathwsnwsnggngaygcngarmgnacnaarmgnggngargcncayytnytngaygcnathwsnytngcnmgngaygtnggngcnacncaygtntgyggnathytntaywsngcnttycaraartaygcnacnccngtnacngcngayggnathmgnggnwsnathgargtngtnmgnmgngtngcngaraargcncargcnwsnggnathacnytnggnatggargtngtnaaymgntaygarwsnaaygtnytnaayacngcnmgncargcnathgcntaygtnaaraargtngaratgccnaaygtnaarytncayytngaytgytaycayatgaayathgargargcngaywsngcngargcnathmgngargcnggngayytnytnggntayttycayacnggngaywsncaymgnggntayytnggnwsnggnwsngtngayttyccnwsngtnttymgngcnytngarwsnathaaytaycarggnccnathacnttygarwsnttywsnwsngcngtngtnggncarccnytngarggnathytnggnathtggmgnaayytntgggargaywsnmgngayytngcngcncaygcnaargcntayacngaygtncaratgaarwsngcnmgngargcnytnggnmgncaraaymgn

SEQ ID NO: 48 - protein, 293 aa, Asaia platycodi
MNKLGLHAFVWTAGWTPEDAAMAIRSTAELGYDLIEASTMDLKAFDVPATLRELERNKLGITMSFGLTSDMDISSGDAERTKRGEAHLLDAISLARDVGATHVCGILYSAFQKYATPVTADGIRGSIEVVRRVAEKAQASGITLGMEVVNRYESNVLNTARQAIAYVKKVEMPNVKLHLDCYHMNIEEADSAEAIREAGDLLGYFHTGDSHRGYLGSGSVDFPSVFRALESINYQGPITFESFSSAVVGQPLEGILGIWRNLWEDSRDLAAHAKAYTDVQMKSAREALGRQNR

SEQ ID NO: 49 - DNA, 876 bp, Artificial Sequence
  Synthetic
  misc_feature (6)..(6): n is a, c, g, or t
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (75)..(75): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (150)..(150): n is a, c, g, or t
  misc_feature (156)..(156): n is a, c, g, or t
  misc_feature (162)..(162): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (336)..(336): n is a, c, g, or t
  misc_feature (351)..(351): n is a, c, g, or t
  misc_feature (357)..(357): n is a, c, g, or t
  misc_feature (366)..(366): n is a, c, g, or t
  misc_feature (378)..(378): n is a, c, g, or t
  misc_feature (381)..(381): n is a, c, g, or t
  misc_feature (387)..(387): n is a, c, g, or t
  misc_feature (390)..(390): n is a, c, g, or t
  misc_feature (396)..(396): n is a, c, g, or t
  misc_feature (402)..(402): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (429)..(429): n is a, c, g, or t
  misc_feature (435)..(435): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (501)..(501): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (570)..(570): n is a, c, g, or t
  misc_feature (573)..(573): n is a, c, g, or t
  misc_feature (576)..(576): n is a, c, g, or t
  misc_feature (582)..(582): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (669)..(669): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (699)..(699): n is a, c, g, or t
  misc_feature (705)..(705): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (744)..(744): n is a, c, g, or t
  misc_feature (747)..(747): n is a, c, g, or t
  misc_feature (750)..(750): n is a, c, g, or t
  misc_feature (756)..(756): n is a, c, g, or t
  misc_feature (759)..(759): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (867)..(867): n is a, c, g, or t
atgwsnaarytnggngtncaygcnytngtntgggtnggnggntggwsncaygargartgymgnacngcnathacnaaracngcngarytnggntaygaytayathgarathccngcnytngayccnwsnwsnathgaygtnaarttyacncayacncarytnaargaraayaayytnggngcnacngtnwsnytnggnytnwsnmgncaygcngayathwsnwsngargayccngargtngtngcnmgnggngarwsnatgytnathgaygcnytnaaygtnacnmgngayathggnggnacncayatgtgyggnathytnttywsngcnytnacnaartayatgcayccnaaracngaycarggnathaayaaywsngcngargtnytntaymgnathgcngaraargcnaaracngcngarathgcnathggnathgargtngtnaaymgntaygaracnaayytnytnaayacnggngcngargcnatggaratgytnaarytnathggnwsngayaaygtntaygtncayytngaywsntaycayatgaayathgargarwsnggnytnggnaaygcnathmgnggntgygcngarmgnytnggntayttycayathggngarwsncaymgnggntayytnggnacnggnaayathgayttymgngayathttyaargcnytngcngayathggntaywsnggnccnathacnttygarwsnttywsnwsngarathgtngcnccngayytnwsnaayathytnggnathtggmgnaayytntgggargaywsntaygayytngcnmgncaygcnaargarttyathgarathcarcaraarwsngcncargaracnttymgnaaygarcar

SEQ ID NO: 50 - protein, 292 aa, SCGC AAA240-J09
MSKLGVHALVWVGGWSHEECRTAITKTAELGYDYIEIPALDPSSIDVKFTHTQLKENNLGATVSLGLSRHADISSEDPEVVARGESMLIDALNVTRDIGGTHMCGILFSALTKYMHPKTDQGINNSAEVLYRIAEKAKTAEIAIGIEVVNRYETNLLNTGAEAMEMLKLIGSDNVYVHLDSYHMNIEESGLGNAIRGCAERLGYFHIGESHRGYLGTGNIDFRDIFKALADIGYSGPITFESFSSEIVAPDLSNILGIWRNLWEDSYDLARHAKEFIEIQQKSAQETFRNEQ

SEQ ID NO: 51 - DNA, 903 bp, Artificial Sequence
  Synthetic
  misc_feature (12)..(12): n is a, c, g, or t
  misc_feature (24)..(24): n is a, c, g, or t
  misc_feature (30)..(30): n is a, c, g, or t
  misc_feature (39)..(39): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (66)..(66): n is a, c, g, or t
  misc_feature (69)..(69): n is a, c, g, or t
  misc_feature (84)..(84): n is a, c, g, or t
  misc_feature (87)..(87): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (108)..(108): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (171)..(171): n is a, c, g, or t
  misc_feature (174)..(174): n is a, c, g, or t
  misc_feature (186)..(186): n is a, c, g, or t
  misc_feature (189)..(189): n is a, c, g, or t
  misc_feature (195)..(195): n is a, c, g, or t
  misc_feature (198)..(198): n is a, c, g, or t
  misc_feature (204)..(204): n is a, c, g, or t
  misc_feature (207)..(207): n is a, c, g, or t
  misc_feature (210)..(210): n is a, c, g, or t
  misc_feature (213)..(213): n is a, c, g, or t
  misc_feature (216)..(216): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (339)..(339): n is a, c, g, or t
  misc_feature (345)..(345): n is a, c, g, or t
  misc_feature (348)..(348): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (381)..(381): n is a, c, g, or t
  misc_feature (390)..(390): n is a, c, g, or t
  misc_feature (393)..(393): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (423)..(423): n is a, c, g, or t
  misc_feature (429)..(429): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (450)..(450): n is a, c, g, or t
  misc_feature (456)..(456): n is a, c, g, or t
  misc_feature (474)..(474): n is a, c, g, or t
  misc_feature (480)..(480): n is a, c, g, or t
  misc_feature (489)..(489): n is a, c, g, or t
  misc_feature (492)..(492): n is a, c, g, or t
  misc_feature (495)..(495): n is a, c, g, or t
  misc_feature (501)..(501): n is a, c, g, or t
  misc_feature (504)..(504): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (540)..(540): n is a, c, g, or t
  misc_feature (543)..(543): n is a, c, g, or t
  misc_feature (549)..(549): n is a, c, g, or t
  misc_feature (555)..(555): n is a, c, g, or t
  misc_feature (585)..(585): n is a, c, g, or t
  misc_feature (591)..(591): n is a, c, g, or t
  misc_feature (594)..(594): n is a, c, g, or t
  misc_feature (603)..(603): n is a, c, g, or t
  misc_feature (615)..(615): n is a, c, g, or t
  misc_feature (618)..(618): n is a, c, g, or t
  misc_feature (621)..(621): n is a, c, g, or t
  misc_feature (636)..(636): n is a, c, g, or t
  misc_feature (642)..(642): n is a, c, g, or t
  misc_feature (648)..(648): n is a, c, g, or t
  misc_feature (651)..(651): n is a, c, g, or t
  misc_feature (657)..(657): n is a, c, g, or t
  misc_feature (660)..(660): n is a, c, g, or t
  misc_feature (663)..(663): n is a, c, g, or t
  misc_feature (666)..(666): n is a, c, g, or t
  misc_feature (675)..(675): n is a, c, g, or t
  misc_feature (678)..(678): n is a, c, g, or t
  misc_feature (681)..(681): n is a, c, g, or t
  misc_feature (693)..(693): n is a, c, g, or t
  misc_feature (696)..(696): n is a, c, g, or t
  misc_feature (699)..(699): n is a, c, g, or t
  misc_feature (702)..(702): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (720)..(720): n is a, c, g, or t
  misc_feature (723)..(723): n is a, c, g, or t
  misc_feature (726)..(726): n is a, c, g, or t
  misc_feature (729)..(729): n is a, c, g, or t
  misc_feature (738)..(738): n is a, c, g, or t
  misc_feature (744)..(744): n is a, c, g, or t
  misc_feature (750)..(750): n is a, c, g, or t
  misc_feature (756)..(756): n is a, c, g, or t
  misc_feature (759)..(759): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (777)..(777): n is a, c, g, or t
  misc_feature (780)..(780): n is a, c, g, or t
  misc_feature (783)..(783): n is a, c, g, or t
  misc_feature (792)..(792): n is a, c, g, or t
  misc_feature (810)..(810): n is a, c, g, or t
  misc_feature (819)..(819): n is a, c, g, or t
  misc_feature (822)..(822): n is a, c, g, or t
  misc_feature (831)..(831): n is a, c, g, or t
  misc_feature (834)..(834): n is a, c, g, or t
  misc_feature (837)..(837): n is a, c, g, or t
  misc_feature (843)..(843): n is a, c, g, or t
  misc_feature (849)..(849): n is a, c, g, or t
  misc_feature (861)..(861): n is a, c, g, or t
  misc_feature (864)..(864): n is a, c, g, or t
  misc_feature (873)..(873): n is a, c, g, or t
  misc_feature (879)..(879): n is a, c, g, or t
  misc_feature (882)..(882): n is a, c, g, or t
  misc_feature (885)..(885): n is a, c, g, or t
  misc_feature (888)..(888): n is a, c, g, or t
  misc_feature (891)..(891): n is a, c, g, or t
  misc_feature (894)..(894): n is a, c, g, or t
  misc_feature (900)..(900): n is a, c, g, or t
  misc_feature (903)..(903): n is a, c, g, or t
atgaaycarccnaaraayaayytnathggnathcayggntayaayytngtnggntgytgggaymgnacncaytgygaraargcnytnaargtngcnwsncarathggntaywsnytngtngargtnccngtnathgayccnytnttygayacncargcnacnaargarytngcnaaraartayggnytncarytnwsntgywsngtnggnytnwsngargayacngayathwsnwsnytngaygarwsngtnmgnaarcarggngarcargtnytnatgacngcngtngarmgngcncayacnathggnwsnwsnathgtntgyggngtnathtaywsnaarytnggnaartaycaymgngcngcnacnmgncaraaygtngaraaywsngtngarathytnmgnmgngtngcncaraargcncarwsntggggngtncarytnggnytngargtntgyaayaartaygaracnaayytnathaayacngcnggngaygcnytnaaratgathgargcnathggnatgccnaaygtngtngtncayytngaygcntaycayatgaayathgaygaraaygayccnathgcngcnathtaywsntgycayaaymgnytnggntayttycayathggngarwsncaymgnggntayytnggnacnggnaayathwsnytnmgnaayatgttymgngcnytngcncargtnggntaywsnggnccnytngtnttygarwsnttywsnaaygcnathgtnwsnccnttygtnacngargcnytngcnathtggmgnaaycartgggargayggngargargtngcnaarcaygcnytngcnttygtncarwsngartggttygcngcncaraarwsnaaracnacnccnytnytnwsntaymgnacn

SEQ ID NO: 52 - protein, 301 aa, Galdieria sulphuraria
MNQPKNNLIGIHGYNLVGCWDRTHCEKALKVASQIGYSLVEVPVIDPLFDTQATKELAKKYGLQLSCSVGLSEDTDISSLDESVRKQGEQVLMTAVERAHTIGSSIVCGVIYSKLGKYHRAATRQNVENSVEILRRVAQKAQSWGVQLGLEVCNKYETNLINTAGDALKMIEAIGMPNVVVHLDAYHMNIDENDPIAAIYSCHNRLGYFHIGESHRGYLGTGNISLRNMFRALAQVGYSGPLVFESFSNAIVSPFVTEALAIWRNQWEDGEEVAKHALAFVQSEWFAAQKSKTTPLLSYRT

SEQ ID NO: 53 - DNA, 960 bp, Artificial Sequence
  Synthetic
  misc_feature (6)..(6): n is a, c, g, or t
  misc_feature (9)..(9): n is a, c, g, or t
  misc_feature (12)..(12): n is a, c, g, or t
  misc_feature (15)..(15): n is a, c, g, or t
  misc_feature (18)..(18): n is a, c, g, or t
  misc_feature (21)..(21): n is a, c, g, or t
  misc_feature (24)..(24): n is a, c, g, or t
  misc_feature (30)..(30): n is a, c, g, or t
  misc_feature (45)..(45): n is a, c, g, or t
  misc_feature (48)..(48): n is a, c, g, or t
  misc_feature (54)..(54): n is a, c, g, or t
  misc_feature (57)..(57): n is a, c, g, or t
  misc_feature (72)..(72): n is a, c, g, or t
  misc_feature (81)..(81): n is a, c, g, or t
  misc_feature (87)..(87): n is a, c, g, or t
  misc_feature (96)..(96): n is a, c, g, or t
  misc_feature (105)..(105): n is a, c, g, or t
  misc_feature (108)..(108): n is a, c, g, or t
  misc_feature (111)..(111): n is a, c, g, or t
  misc_feature (123)..(123): n is a, c, g, or t
  misc_feature (126)..(126): n is a, c, g, or t
  misc_feature (141)..(141): n is a, c, g, or t
  misc_feature (144)..(144): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (165)..(165): n is a, c, g, or t
  misc_feature (171)..(171): n is a, c, g, or t
  misc_feature (174)..(174): n is a, c, g, or t
  misc_feature (177)..(177): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (198)..(198): n is a, c, g, or t
  misc_feature (201)..(201): n is a, c, g, or t
  misc_feature (210)..(210): n is a, c, g, or t
  misc_feature (216)..(216): n is a, c, g, or t
  misc_feature (219)..(219): n is a, c, g, or t
  misc_feature (228)..(228): n is a, c, g, or t
  misc_feature (231)..(231): n is a, c, g, or t
  misc_feature (243)..(243): n is a, c, g, or t
  misc_feature (246)..(246): n is a, c, g, or t
  misc_feature (252)..(252): n is a, c, g, or t
  misc_feature (255)..(255): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (270)..(270): n is a, c, g, or t
  misc_feature (273)..(273): n is a, c, g, or t
  misc_feature (282)..(282): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (306)..(306): n is a, c, g, or t
  misc_feature (309)..(309): n is a, c, g, or t
  misc_feature (312)..(312): n is a, c, g, or t
  misc_feature (321)..(321): n is a, c, g, or t
  misc_feature (330)..(330): n is a, c, g, or t
  misc_feature (333)..(333): n is a, c, g, or t
  misc_feature (339)..(339): n is a, c, g, or t
  misc_feature (342)..(342): n is a, c, g, or t
  misc_feature (345)..(345): n is a, c, g, or t
  misc_feature (351)..(351): n is a, c, g, or t
  misc_feature (354)..(354): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (384)..(384): n is a, c, g, or t
  misc_feature (387)..(387): n is a, c, g, or t
  misc_feature (396)..(396): n is a, c, g, or t
  misc_feature (402)..(402): n is a, c, g, or t
  misc_feature (405)..(405): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (438)..(438): n is a, c, g, or t
  misc_feature (447)..(447): n is a, c, g, or t
  misc_feature (450)..(450): n is a, c, g, or t
  misc_feature (459)..(459): n is a, c, g, or t
  misc_feature (462)..(462): n is a, c, g, or t
  misc_feature (465)..(465): n is a, c, g, or t
  misc_feature (468)..(468): n is a, c, g, or t
  misc_feature (471)..(471): n is a, c, g, or t
  misc_feature (480)..(480): n is a, c, g, or t
  misc_feature (486)..(486): n is a, c, g, or t
  misc_feature (492)..(492): n is a, c, g, or t
  misc_feature (495)..(495): n is a, c, g, or t
  misc_feature (501)..(501): n is a, c, g, or t
  misc_feature (504)..(504): n is a, c, g, or t
  misc_feature (507)..(507): n is a, c, g, or t
  misc_feature (513)..(513): n is a, c, g, or t
  misc_feature (531)..(531): n is a, c, g, or t
  misc_feature (537)..(537): n is a, c, g, or t
  misc_feature (546)..(546): n is a, c, g, or t
  misc_feature (549)..(549): n is a, c, g, or t
  misc_feature (552)..(552): n is a, c, g, or t
  misc_feature (558)..(558): n is a, c, g, or t
  misc_feature (561)..(561): n is a, c, g, or t
  misc_feature (576)..(576): n is a, c, g, or t
  misc_feature (582)..(582): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (606)..(606): n is a, c, g, or t
  misc_feature (612)..(612): n is a, c, g, or t
  misc_feature (642)..(642): n is a, c, g, or t
  misc_feature (648)..(648): n is a, c, g, or t
  misc_feature (651)..(651): n is a, c, g, or t
  misc_feature (660)..(660): n is a, c, g, or t
  misc_feature (672)..(672): n is a, c, g, or t
  misc_feature (675)..(675): n is a, c, g, or t
  misc_feature (678)..(678): n is a, c, g, or t
  misc_feature (693)..(693): n is a, c, g, or t
  misc_feature (699)..(699): n is a, c, g, or t
  misc_feature (705)..(705): n is a, c, g, or t
  misc_feature (708)..(708): n is a, c, g, or t
  misc_feature (714)..(714): n is a, c, g, or t
  misc_feature (717)..(717): n is a, c, g, or t
  misc_feature (720)..(720): n is a, c, g, or t
  misc_feature (723)..(723): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (774)..(774): n is a, c, g, or t
  misc_feature (777)..(777): n is a, c, g, or t
  misc_feature (780)..(780): n is a, c, g, or t
  misc_feature (783)..(783): n is a, c, g, or t
  misc_feature (786)..(786): n is a, c, g, or t
  misc_feature (795)..(795): n is a, c, g, or t
  misc_feature (801)..(801): n is a, c, g, or t
  misc_feature (807)..(807): n is a, c, g, or t
  misc_feature (813)..(813): n is a, c, g, or t
  misc_feature (816)..(816): n is a, c, g, or t
  misc_feature (819)..(819): n is a, c, g, or t
  misc_feature (825)..(825): n is a, c, g, or t
  misc_feature (828)..(828): n is a, c, g, or t
  misc_feature (834)..(834): n is a, c, g, or t
  misc_feature (837)..(837): n is a, c, g, or t
  misc_feature (840)..(840): n is a, c, g, or t
  misc_feature (849)..(849): n is a, c, g, or t
  misc_feature (867)..(867): n is a, c, g, or t
  misc_feature (876)..(876): n is a, c, g, or t
  misc_feature (879)..(879): n is a, c, g, or t
  misc_feature (888)..(888): n is a, c, g, or t
  misc_feature (891)..(891): n is a, c, g, or t
  misc_feature (894)..(894): n is a, c, g, or t
  misc_feature (900)..(900): n is a, c, g, or t
  misc_feature (906)..(906): n is a, c, g, or t
  misc_feature (918)..(918): n is a, c, g, or t
  misc_feature (921)..(921): n is a, c, g, or t
  misc_feature (930)..(930): n is a, c, g, or t
  misc_feature (936)..(936): n is a, c, g, or t
  misc_feature (939)..(939): n is a, c, g, or t
  misc_feature (942)..(942): n is a, c, g, or t
  misc_feature (945)..(945): n is a, c, g, or t
  misc_feature (948)..(948): n is a, c, g, or t
  misc_feature (951)..(951): n is a, c, g, or t
  misc_feature (957)..(957): n is a, c, g, or t
  misc_feature (960)..(960): n is a, c, g, or t
atgytnmgnwsnytnwsnccnwsnaarmgncaraayaarathmgnmgngarggnmgnaaraargargargtnaayaayytnathggnathcayggntayaayytngtnggntgytgggaymgnacncaytgygaraargcnytnaargtngcnwsncarathggntaywsnytngtngargtnccngtnathgayccnytnttygayacncargcnacnaargarytngcnaaraartayggnytncarytnwsntgywsngtnggnytnwsngargayacngayathwsnwsnytngaygarwsngtnmgnaarcarggngarcargtnytnatgacngcngtngarmgngcncayacnathggnwsnwsnathgtntgyggngtnathtaywsnaarytnggnaartaycaymgngcngcnacnmgncaraaygtngaraaywsngtngarathytnmgnmgngtngcncaraargcncarwsntggggngtncarytnggnytngargtntgyaayaartaygaracnaayytnathaayacngcnggngaygcnytnaaratgathgargcnathggnatgccnaaygtngtngtncayytngaygcntaycayatgaayathgaygaraaygayccnathgcngcnathtaywsntgycayaaymgnytnggntayttycayathggngarwsncaymgnggntayytnggnacnggnaayathwsnytnmgnaayatgttymgngcnytngcncargtnggntaywsnggnccnytngtnttygarwsnttywsnaaygcnathgtnwsnccnttygtnacngargcnytngcnathtggmgnaaycartgggargayggngargargtngcnaarcaygcnytngcnttygtncarwsngartggttygcngcncaraarwsnaaracnacnccnytnytnwsntaymgnacn

SEQ ID NO: 54 - protein, 320 aa, Galdieria sulphuraria
MLRSLSPSKRQNKIRREGRKKEEVNNLIGIHGYNLVGCWDRTHCEKALKVASQIGYSLVEVPVIDPLFDTQATKELAKKYGLQLSCSVGLSEDTDISSLDESVRKQGEQVLMTAVERAHTIGSSIVCGVIYSKLGKYHRAATRQNVENSVEILRRVAQKAQSWGVQLGLEVCNKYETNLINTAGDALKMIEAIGMPNVVVHLDAYHMNIDENDPIAAIYSCHNRLGYFHIGESHRGYLGTGNISLRNMFRALAQVGYSGPLVFESFSNAIVSPFVTEALAIWRNQWEDGEEVAKHALAFVQSEWFAAQKSKTTPLLSYRT

SEQ ID NO: 55 - DNA, 1113 bp, Artificial Sequence
  Synthetic
  misc_feature (6)..(6): n is a, c, g, or t
  misc_feature (9)..(9): n is a, c, g, or t
  misc_feature (12)..(12): n is a, c, g, or t
  misc_feature (18)..(18): n is a, c, g, or t
  misc_feature (21)..(21): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (33)..(33): n is a, c, g, or t
  misc_feature (39)..(39): n is a, c, g, or t
  misc_feature (42)..(42): n is a, c, g, or t
  misc_feature (45)..(45): n is a, c, g, or t
  misc_feature (48)..(48): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (105)..(105): n is a, c, g, or t
  misc_feature (108)..(108): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (135)..(135): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (171)..(171): n is a, c, g, or t
  misc_feature (174)..(174): n is a, c, g, or t
  misc_feature (177)..(177): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (210)..(210): n is a, c, g, or t
  misc_feature (213)..(213): n is a, c, g, or t
  misc_feature (216)..(216): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (231)..(231): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (267)..(267): n is a, c, g, or t
  misc_feature (270)..(270): n is a, c, g, or t
  misc_feature (273)..(273): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (291)..(291): n is a, c, g, or t
  misc_feature (297)..(297): n is a, c, g, or t
  misc_feature (303)..(303): n is a, c, g, or t
  misc_feature (312)..(312): n is a, c, g, or t
  misc_feature (318)..(318): n is a, c, g, or t
  misc_feature (321)..(321): n is a, c, g, or t
  misc_feature (324)..(324): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (336)..(336): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (384)..(384): n is a, c, g, or t
  misc_feature (387)..(387): n is a, c, g, or t
  misc_feature (393)..(393): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (444)..(444): n is a, c, g, or t
  misc_feature (447)..(447): n is a, c, g, or t
  misc_feature (456)..(456): n is a, c, g, or t
  misc_feature (462)..(462): n is a, c, g, or t
  misc_feature (465)..(465): n is a, c, g, or t
  misc_feature (468)..(468): n is a, c, g, or t
  misc_feature (477)..(477): n is a, c, g, or t
  misc_feature (480)..(480): n is a, c, g, or t
  misc_feature (486)..(486): n is a, c, g, or t
  misc_feature (489)..(489): n is a, c, g, or t
  misc_feature (495)..(495): n is a, c, g, or t
  misc_feature (504)..(504): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (534)..(534): n is a, c, g, or t
  misc_feature (540)..(540): n is a, c, g, or t
  misc_feature (543)..(543): n is a, c, g, or t
  misc_feature (546)..(546): n is a, c, g, or t
  misc_feature (558)..(558): n is a, c, g, or t
  misc_feature (564)..(564): n is a, c, g, or t
  misc_feature (570)..(570): n is a, c, g, or t
  misc_feature (573)..(573): n is a, c, g, or t
  misc_feature (576)..(576): n is a, c, g, or t
  misc_feature (579)..(579): n is a, c, g, or t
  misc_feature (588)..(588): n is a, c, g, or t
  misc_feature (594)..(594): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (612)..(612): n is a, c, g, or t
  misc_feature (615)..(615): n is a, c, g, or t
  misc_feature (621)..(621): n is a, c, g, or t
  misc_feature (624)..(624): n is a, c, g, or t
  misc_feature (627)..(627): n is a, c, g, or t
  misc_feature (630)..(630): n is a, c, g, or t
  misc_feature (639)..(639): n is a, c, g, or t
  misc_feature (642)..(642): n is a, c, g, or t
  misc_feature (645)..(645): n is a, c, g, or t
  misc_feature (654)..(654): n is a, c, g, or t
  misc_feature (657)..(657): n is a, c, g, or t
  misc_feature (663)..(663): n is a, c, g, or t
  misc_feature (666)..(666): n is a, c, g, or t
  misc_feature (672)..(672): n is a, c, g, or t
  misc_feature (675)..(675): n is a, c, g, or t
  misc_feature (678)..(678): n is a, c, g, or t
  misc_feature (681)..(681): n is a, c, g, or t
  misc_feature (684)..(684): n is a, c, g, or t
  misc_feature (690)..(690): n is a, c, g, or t
  misc_feature (693)..(693): n is a, c, g, or t
  misc_feature (699)..(699): n is a, c, g, or t
  misc_feature (708)..(708): n is a, c, g, or t
  misc_feature (714)..(714): n is a, c, g, or t
  misc_feature (717)..(717): n is a, c, g, or t
  misc_feature (723)..(723): n is a, c, g, or t
  misc_feature (726)..(726): n is a, c, g, or t
  misc_feature (735)..(735): n is a, c, g, or t
  misc_feature (741)..(741): n is a, c, g, or t
  misc_feature (747)..(747): n is a, c, g, or t
  misc_feature (756)..(756): n is a, c, g, or t
  misc_feature (765)..(765): n is a, c, g, or t
  misc_feature (771)..(771): n is a, c, g, or t
  misc_feature (783)..(783): n is a, c, g, or t
  misc_feature (789)..(789): n is a, c, g, or t
  misc_feature (813)..(813): n is a, c, g, or t
  misc_feature (816)..(816): n is a, c, g, or t
  misc_feature (819)..(819): n is a, c, g, or t
  misc_feature (825)..(825): n is a, c, g, or t
  misc_feature (828)..(828): n is a, c, g, or t
  misc_feature (831)..(831): n is a, c, g, or t
  misc_feature (834)..(834): n is a, c, g, or t
  misc_feature (837)..(837): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (867)..(867): n is a, c, g, or t
  misc_feature (870)..(870): n is a, c, g, or t
  misc_feature (876)..(876): n is a, c, g, or t
  misc_feature (882)..(882): n is a, c, g, or t
  misc_feature (885)..(885): n is a, c, g, or t
  misc_feature (888)..(888): n is a, c, g, or t
  misc_feature (891)..(891): n is a, c, g, or t
  misc_feature (894)..(894): n is a, c, g, or t
  misc_feature (900)..(900): n is a, c, g, or t
  misc_feature (906)..(906): n is a, c, g, or t
  misc_feature (918)..(918): n is a, c, g, or t
  misc_feature (921)..(921): n is a, c, g, or t
  misc_feature (927)..(927): n is a, c, g, or t
  misc_feature (930)..(930): n is a, c, g, or t
  misc_feature (933)..(933): n is a, c, g, or t
  misc_feature (936)..(936): n is a, c, g, or t
  misc_feature (939)..(939): n is a, c, g, or t
  misc_feature (942)..(942): n is a, c, g, or t
  misc_feature (954)..(954): n is a, c, g, or t
  misc_feature (957)..(957): n is a, c, g, or t
  misc_feature (963)..(963): n is a, c, g, or t
  misc_feature (972)..(972): n is a, c, g, or t
  misc_feature (978)..(978): n is a, c, g, or t
  misc_feature (981)..(981): n is a, c, g, or t
  misc_feature (987)..(987): n is a, c, g, or t
  misc_feature (990)..(990): n is a, c, g, or t
  misc_feature (993)..(993): n is a, c, g, or t
  misc_feature (996)..(996): n is a, c, g, or t
  misc_feature (1002)..(1002): n is a, c, g, or t
  misc_feature (1005)..(1005): n is a, c, g, or t
  misc_feature (1011)..(1011): n is a, c, g, or t
  misc_feature (1014)..(1014): n is a, c, g, or t
  misc_feature (1026)..(1026): n is a, c, g, or t
  misc_feature (1032)..(1032): n is a, c, g, or t
  misc_feature (1038)..(1038): n is a, c, g, or t
  misc_feature (1050)..(1050): n is a, c, g, or t
  misc_feature (1059)..(1059): n is a, c, g, or t
  misc_feature (1062)..(1062): n is a, c, g, or t
  misc_feature (1065)..(1065): n is a, c, g, or t
  misc_feature (1071)..(1071): n is a, c, g, or t
  misc_feature (1074)..(1074): n is a, c, g, or t
  misc_feature (1077)..(1077): n is a, c, g, or t
  misc_feature (1083)..(1083): n is a, c, g, or t
  misc_feature (1086)..(1086): n is a, c, g, or t
  misc_feature (1089)..(1089): n is a, c, g, or t
  misc_feature (1107)..(1107): n is a, c, g, or t
  misc_feature (1110)..(1110): n is a, c, g, or t
  misc_feature (1113)..(1113): n is a, c, g, or t
atgwsngcnccnttygcnmgnccnwsngcnwsnathgcnacnccnmgnathcaymgnacnmgnmgngarmgnytnmgnytngaygtngcnccnwsnwsnaarwsngcngtnccnacnacnacnacnacnmgnytnccngcnccnacngtncaymgngcnwsngtnccnacnmgngcncaygcnmgnggnggngcnacnwsnwsngcngcnacnwsnwsnggngcnwsnwsnccngtnwsngcnwsnwsnccnytnggngtncaygcnytngtntggacnggnggntggwsngargcngaygcncaygaygcntgygcnmgnacngcngcngcnggntaygayathathgarathccnytnytnaayccnwsnwsngtngaygtngcnatgacnaaraaygcnytngcngcncayggnytnmgngtngcnacnwsnytnggnytnwsnttygaygcngaygtnwsnwsngaygayytnwsnathgtngcnaarggnaaygarytnytngaygcngcnytngaygtnwsngtnggnathggngcnacncayatgtgyggnathytntaywsngcnytnggnaartayccnaayggntgyacngcnacnggnmgngcnaaygcngtngcngcnathaarmgnytngcnaaraargcngcngayacnwsngaygtngtnytnggnytngargtngtnaaymgntaygaracnaayytnytnaayacngcngarcargcnatggcnttyytnaaygaygtngaygarccnaaygtnaarathcayytngayacntaycayatgaayathgargarmgnwsnytngargcngcngtngtnytntgyggngaymgnytnggntaygtncaygtnggngarwsngaymgnggngcnytnggnatgggnaaygtngayttygaywsnytnttymgnggnytnmgnmgngtngaytaygayggnccnathacnttygarwsnttywsnwsngaygtngtnwsnccngayytnwsngaygtnytntgyathtggmgnaayccntggggnttygarcarmgngaygarytngcngtngaygcnmgnwsnttygtnytnggnatgatggayaarcayggnytnmgn

SEQ ID NO: 56 - protein, 371 aa, Micromonas sp. RCC299
MSAPFARPSASIATPRIHRTRRERLRLDVAPSSKSAVPTTTTTRLPAPTVHRASVPTRAHARGGATSSAATSSGASSPVSASSPLGVHALVWTGGWSEADAHDACARTAAAGYDIIEIPLLNPSSVDVAMTKNALAAHGLRVATSLGLSFDADVSSDDLSIVAKGNELLDAALDVSVGIGATHMCGILYSALGKYPNGCTATGRANAVAAIKRLAKKAADTSDVVLGLEVVNRYETNLLNTAEQAMAFLNDVDEPNVKIHLDTYHMNIEERSLEAAVVLCGDRLGYVHVGESDRGALGMGNVDFDSLFRGLRRVDYDGPITFESFSSDVVSPDLSDVLCIWRNPWGFEQRDELAVDARSFVLGMMDKHGLR

SEQ ID NO: 57 - DNA, 1170 bp, Artificial Sequence
  Synthetic
  misc_feature (6)..(6): n is a, c, g, or t
  misc_feature (9)..(9): n is a, c, g, or t
  misc_feature (12)..(12): n is a, c, g, or t
  misc_feature (18)..(18): n is a, c, g, or t
  misc_feature (21)..(21): n is a, c, g, or t
  misc_feature (27)..(27): n is a, c, g, or t
  misc_feature (30)..(30): n is a, c, g, or t
  misc_feature (33)..(33): n is a, c, g, or t
  misc_feature (36)..(36): n is a, c, g, or t
  misc_feature (39)..(39): n is a, c, g, or t
  misc_feature (42)..(42): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (102)..(102): n is a, c, g, or t
  misc_feature (105)..(105): n is a, c, g, or t
  misc_feature (108)..(108): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (135)..(135): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (174)..(174): n is a, c, g, or t
  misc_feature (180)..(180): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (213)..(213): n is a, c, g, or t
  misc_feature (216)..(216): n is a, c, g, or t
  misc_feature (219)..(219): n is a, c, g, or t
  misc_feature (231)..(231): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (249)..(249): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (273)..(273): n is a, c, g, or t
  misc_feature (276)..(276): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (336)..(336): n is a, c, g, or t
  misc_feature (339)..(339): n is a, c, g, or t
  misc_feature (342)..(342): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (414)..(414): n is a, c, g, or t
  misc_feature (417)..(417): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (441)..(441): n is a, c, g, or t
  misc_feature (447)..(447): n is a, c, g, or t
  misc_feature (450)..(450): n is a, c, g, or t
  misc_feature (456)..(456): n is a, c, g, or t
  misc_feature (459)..(459): n is a, c, g, or t
  misc_feature (462)..(462): n is a, c, g, or t
  misc_feature (465)..(465): n is a, c, g, or t
  misc_feature (468)..(468): n is a, c, g, or t
  misc_feature (471)..(471): n is a, c, g, or t
  misc_feature (474)..(474): n is a, c, g, or t
  misc_feature (477)..(477): n is a, c, g, or t
  misc_feature (486)..(486): n is a, c, g, or t
  misc_feature (492)..(492): n is a, c, g, or t
  misc_feature (495)..(495): n is a, c, g, or t
  misc_feature (498)..(498): n is a, c, g, or t
  misc_feature (501)..(501): n is a, c, g, or t
  misc_feature (516)..(516): n is a, c, g, or t
  misc_feature (519)..(519): n is a, c, g, or t
  misc_feature (522)..(522): n is a, c, g, or t
  misc_feature (525)..(525): n is a, c, g, or t
  misc_feature (531)..(531): n is a, c, g, or t
  misc_feature (534)..(534): n is a, c, g, or t
  misc_feature (537)..(537): n is a, c, g, or t
  misc_feature (546)..(546): n is a, c, g, or t
  misc_feature (549)..(549): n is a, c, g, or t
  misc_feature (558)..(558): n is a, c, g, or t
  misc_feature (570)..(570): n is a, c, g, or t
  misc_feature (573)..(573): n is a, c, g, or t
  misc_feature (576)..(576): n is a, c, g, or t
  misc_feature (588)..(588): n is a, c, g, or t
  misc_feature (594)..(594): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (624)..(624): n is a, c, g, or t
  misc_feature (627)..(627): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (651)..(651): n is a, c, g, or t
  misc_feature (657)..(657): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (675)..(675): n is a, c, g, or t
  misc_feature (678)..(678): n is a, c, g, or t
  misc_feature (681)..(681): n is a, c, g, or t
  misc_feature (684)..(684): n is a, c, g, or t
  misc_feature (693)..(693): n is a, c, g, or t
  misc_feature (696)..(696): n is a, c, g, or t
  misc_feature (699)..(699): n is a, c, g, or t
  misc_feature (705)..(705): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (720)..(720): n is a, c, g, or t
  misc_feature (726)..(726): n is a, c, g, or t
  misc_feature (735)..(735): n is a, c, g, or t
  misc_feature (741)..(741): n is a, c, g, or t
  misc_feature (744)..(744): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (777)..(777): n is a, c, g, or t
  misc_feature (783)..(783): n is a, c, g, or t
  misc_feature (798)..(798): n is a, c, g, or t
  misc_feature (801)..(801): n is a, c, g, or t
  misc_feature (804)..(804): n is a, c, g, or t
  misc_feature (810)..(810): n is a, c, g, or t
  misc_feature (816)..(816): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (855)..(855): n is a, c, g, or t
  misc_feature (858)..(858): n is a, c, g, or t
  misc_feature (864)..(864): n is a, c, g, or t
  misc_feature (870)..(870): n is a, c, g, or t
  misc_feature (879)..(879): n is a, c, g, or t
  misc_feature (882)..(882): n is a, c, g, or t
  misc_feature (888)..(888): n is a, c, g, or t
  misc_feature (894)..(894): n is a, c, g, or t
  misc_feature (897)..(897): n is a, c, g, or t
  misc_feature (903)..(903): n is a, c, g, or t
  misc_feature (909)..(909): n is a, c, g, or t
  misc_feature (912)..(912): n is a, c, g, or t
  misc_feature (918)..(918): n is a, c, g, or t
  misc_feature (921)..(921): n is a, c, g, or t
  misc_feature (924)..(924): n is a, c, g, or t
  misc_feature (927)..(927): n is a, c, g, or t
  misc_feature (933)..(933): n is a, c, g, or t
  misc_feature (945)..(945): n is a, c, g, or t
  misc_feature (948)..(948): n is a, c, g, or t
  misc_feature (957)..(957): n is a, c, g, or t
  misc_feature (960)..(960): n is a, c, g, or t
  misc_feature (963)..(963): n is a, c, g, or t
  misc_feature (978)..(978): n is a, c, g, or t
  misc_feature (981)..(981): n is a, c, g, or t
  misc_feature (984)..(984): n is a, c, g, or t
  misc_feature (990)..(990): n is a, c, g, or t
  misc_feature (999)..(999): n is a, c, g, or t
  misc_feature (1005)..(1005): n is a, c, g, or t
  misc_feature (1008)..(1008): n is a, c, g, or t
  misc_feature (1014)..(1014): n is a, c, g, or t
  misc_feature (1017)..(1017): n is a, c, g, or t
  misc_feature (1020)..(1020): n is a, c, g, or t
  misc_feature (1029)..(1029): n is a, c, g, or t
  misc_feature (1032)..(1032): n is a, c, g, or t
  misc_feature (1038)..(1038): n is a, c, g, or t
  misc_feature (1041)..(1041): n is a, c, g, or t
  misc_feature (1047)..(1047): n is a, c, g, or t
  misc_feature (1053)..(1053): n is a, c, g, or t
  misc_feature (1059)..(1059): n is a, c, g, or t
  misc_feature (1071)..(1071): n is a, c, g, or t
  misc_feature (1077)..(1077): n is a, c, g, or t
  misc_feature (1080)..(1080): n is a, c, g, or t
  misc_feature (1083)..(1083): n is a, c, g, or t
  misc_feature (1092)..(1092): n is a, c, g, or t
  misc_feature (1095)..(1095): n is a, c, g, or t
  misc_feature (1104)..(1104): n is a, c, g, or t
  misc_feature (1110)..(1110): n is a, c, g, or t
  misc_feature (1113)..(1113): n is a, c, g, or t
  misc_feature (1122)..(1122): n is a, c, g, or t
  misc_feature (1125)..(1125): n is a, c, g, or t
  misc_feature (1128)..(1128): n is a, c, g, or t
  misc_feature (1131)..(1131): n is a, c, g, or t
  misc_feature (1134)..(1134): n is a, c, g, or t
  misc_feature (1146)..(1146): n is a, c, g, or t
  misc_feature (1149)..(1149): n is a, c, g, or t
  misc_feature (1152)..(1152): n is a, c, g, or t
  misc_feature (1158)..(1158): n is a, c, g, or t
  misc_feature (1161)..(1161): n is a, c, g, or t
atgwsnwsnacnttygcnacntgygcngcnmgngcnacnytnccnwsnccnytnwsnwsnmgnmgnmgnmgngayggngcnccnmgngcnwsnmgngcnmgngtngcnytngcnwsnwsnwsnwsnwsnwsnwsnwsnwsnwsnmgnwsngaymgngaywsnaarccngaymgnaarwsngaygcnathccnccnytngcnaargcncargcnccnwsnttygaygarmgnmgngcnacngaygayccngaymgnccnccngcnccnathacnccnaayaarytnggngtncaygcnytngtnttyacnggngcntgggaygarccngcngcnacnytngcntgygcnggngcnaarmgngcnggntaygayathathgarathccnytnytnwsnccnwsngcngtngayggngcnatgacnaarmgngtngtngargcncayggnytncargcnacnacnwsnytnggnytnmgnttygaygcngaygtnwsnwsngcngaygaygarathgcngcnmgnggngargcnytnytnaaygaygcnytngaraaracnathcaratgggnggnacncayatgtgyggnathytntaywsngcnytnggnaartaygayaarccngtnacnaarmgnggntaygaraaywsnathgcngcnathaarmgngtngcnmgnmgngcnaaygaygcnggngtnathytnggnytngargtngtnaaymgntaygaracnaaygtnytnaayacngcngcncargcnatggarttyathwsngargtnaaygargayaaygtnmgngtncayytngaywsntaycayatgtgyathgargarmgnwsnytnmgncargcngtnaayacntgyggngayaarytnggntaygtncaygtnggngarwsncaymgnggncarytnggnacnggnaaygtngayttytgymgnytnttytayggnytngcngarathcartaymgnggnccnathacnttygarwsnttywsnggnaargtngtnwsngargayytnwsnaayacnytntgygtntggmgngayytntgggargaywsngaygcnytngcnaarcaygcnmgngaytaygtngarmgngcnathgargcngcngcnggngcncaygayaayacnmgngtnathgtnggngaytggtty

SEQ ID NO: 58 - protein, 390 aa, Micromonas pusilla CCMP1545
MSSTFATCAARATLPSPLSSRRRRDGAPRASRARVALASSSSSSSSSSRSDRDSKPDRKSDAIPPLAKAQAPSFDERRATDDPDRPPAPITPNKLGVHALVFTGAWDEPAATLACAGAKRAGYDIIEIPLLSPSAVDGAMTKRVVEAHGLQATTSLGLRFDADVSSADDEIAARGEALLNDALEKTIQMGGTHMCGILYSALGKYDKPVTKRGYENSIAAIKRVARRANDAGVILGLEVVNRYETNVLNTAAQAMEFISEVNEDNVRVHLDSYHMCIEERSLRQAVNTCGDKLGYVHVGESHRGQLGTGNVDFCRLFYGLAEIQYRGPITFESFSGKVVSEDLSNTLCVWRDLWEDSDALAKHARDYVERAIEAAAGAHDNTRVIVGDWF

SEQ ID NO: 59 - DNA, 1023 bp, Artificial Sequence
  Synthetic
  misc_feature (6)..(6): n is a, c, g, or t
  misc_feature (9)..(9): n is a, c, g, or t
  misc_feature (12)..(12): n is a, c, g, or t
  misc_feature (21)..(21): n is a, c, g, or t
  misc_feature (24)..(24): n is a, c, g, or t
  misc_feature (27)..(27): n is a, c, g, or t
  misc_feature (39)..(39): n is a, c, g, or t
  misc_feature (42)..(42): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (66)..(66): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (105)..(105): n is a, c, g, or t
  misc_feature (108)..(108): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (138)..(138): n is a, c, g, or t
  misc_feature (144)..(144): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (165)..(165): n is a, c, g, or t
  misc_feature (168)..(168): n is a, c, g, or t
  misc_feature (177)..(177): n is a, c, g, or t
  misc_feature (180)..(180): n is a, c, g, or t
  misc_feature (189)..(189): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (210)..(210): n is a, c, g, or t
  misc_feature (219)..(219): n is a, c, g, or t
  misc_feature (222)..(222): n is a, c, g, or t
  misc_feature (231)..(231): n is a, c, g, or t
  misc_feature (240)..(240): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (264)..(264): n is a, c, g, or t
  misc_feature (270)..(270): n is a, c, g, or t
  misc_feature (276)..(276): n is a, c, g, or t
  misc_feature (279)..(279): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (306)..(306): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (324)..(324): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (336)..(336): n is a, c, g, or t
  misc_feature (339)..(339): n is a, c, g, or t
  misc_feature (342)..(342): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (363)..(363): n is a, c, g, or t
  misc_feature (372)..(372): n is a, c, g, or t
  misc_feature (375)..(375): n is a, c, g, or t
  misc_feature (381)..(381): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (405)..(405): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (444)..(444): n is a, c, g, or t
  misc_feature (447)..(447): n is a, c, g, or t
  misc_feature (456)..(456): n is a, c, g, or t
  misc_feature (459)..(459): n is a, c, g, or t
  misc_feature (474)..(474): n is a, c, g, or t
  misc_feature (480)..(480): n is a, c, g, or t
  misc_feature (483)..(483): n is a, c, g, or t
  misc_feature (486)..(486): n is a, c, g, or t
  misc_feature (489)..(489): n is a, c, g, or t
  misc_feature (510)..(510): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (528)..(528): n is a, c, g, or t
  misc_feature (531)..(531): n is a, c, g, or t
  misc_feature (534)..(534): n is a, c, g, or t
  misc_feature (540)..(540): n is a, c, g, or t
  misc_feature (543)..(543): n is a, c, g, or t
  misc_feature (552)..(552): n is a, c, g, or t
  misc_feature (564)..(564): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (582)..(582): n is a, c, g, or t
  misc_feature (591)..(591): n is a, c, g, or t
  misc_feature (600)..(600): n is a, c, g, or t
  misc_feature (606)..(606): n is a, c, g, or t
  misc_feature (609)..(609): n is a, c, g, or t
  misc_feature (618)..(618): n is a, c, g, or t
  misc_feature (627)..(627): n is a, c, g, or t
  misc_feature (630)..(630): n is a, c, g, or t
  misc_feature (633)..(633): n is a, c, g, or t
  misc_feature (642)..(642): n is a, c, g, or t
  misc_feature (645)..(645): n is a, c, g, or t
  misc_feature (654)..(654): n is a, c, g, or t
  misc_feature (657)..(657): n is a, c, g, or t
  misc_feature (666)..(666): n is a, c, g, or t
  misc_feature (672)..(672): n is a, c, g, or t
  misc_feature (699)..(699): n is a, c, g, or t
  misc_feature (711)..(711): n is a, c, g, or t
  misc_feature (720)..(720): n is a, c, g, or t
  misc_feature (723)..(723): n is a, c, g, or t
  misc_feature (726)..(726): n is a, c, g, or t
  misc_feature (735)..(735): n is a, c, g, or t
  misc_feature (738)..(738): n is a, c, g, or t
  misc_feature (753)..(753): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (774)..(774): n is a, c, g, or t
  misc_feature (777)..(777): n is a, c, g, or t
  misc_feature (780)..(780): n is a, c, g, or t
  misc_feature (783)..(783): n is a, c, g, or t
  misc_feature (786)..(786): n is a, c, g, or t
  misc_feature (789)..(789): n is a, c, g, or t
  misc_feature (798)..(798): n is a, c, g, or t
  misc_feature (801)..(801): n is a, c, g, or t
  misc_feature (804)..(804): n is a, c, g, or t
  misc_feature (810)..(810): n is a, c, g, or t
  misc_feature (813)..(813): n is a, c, g, or t
  misc_feature (816)..(816): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (828)..(828): n is a, c, g, or t
  misc_feature (834)..(834): n is a, c, g, or t
  misc_feature (837)..(837): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (855)..(855): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (870)..(870): n is a, c, g, or t
  misc_feature (873)..(873): n is a, c, g, or t
  misc_feature (876)..(876): n is a, c, g, or t
  misc_feature (879)..(879): n is a, c, g, or t
  misc_feature (882)..(882): n is a, c, g, or t
  misc_feature (885)..(885): n is a, c, g, or t
  misc_feature (888)..(888): n is a, c, g, or t
  misc_feature (894)..(894): n is a, c, g, or t
  misc_feature (897)..(897): n is a, c, g, or t
  misc_feature (903)..(903): n is a, c, g, or t
  misc_feature (909)..(909): n is a, c, g, or t
  misc_feature (915)..(915): n is a, c, g, or t
  misc_feature (927)..(927): n is a, c, g, or t
  misc_feature (936)..(936): n is a, c, g, or t
  misc_feature (939)..(939): n is a, c, g, or t
  misc_feature (942)..(942): n is a, c, g, or t
  misc_feature (948)..(948): n is a, c, g, or t
  misc_feature (954)..(954): n is a, c, g, or t
  misc_feature (966)..(966): n is a, c, g, or t
  misc_feature (975)..(975): n is a, c, g, or t
  misc_feature (978)..(978): n is a, c, g, or t
  misc_feature (981)..(981): n is a, c, g, or t
  misc_feature (990)..(990): n is a, c, g, or t
  misc_feature (996)..(996): n is a, c, g, or t
  misc_feature (999)..(999): n is a, c, g, or t
  misc_feature (1002)..(1002): n is a, c, g, or t
  misc_feature (1008)..(1008): n is a, c, g, or t
  misc_feature (1014)..(1014): n is a, c, g, or t
  misc_feature (1020)..(1020): n is a, c, g, or t
  misc_feature (1023)..(1023): n is a, c, g, or t
atgwsngcnytnaartgyccnytnytnaayaartayccnytnacnmgnccnwsnytnggnaarccnaartgyggngcngtnwsnacnmgngcngcnwsncargtngtnaaygcngcngcngtnytnccnaaraayytnathggnathcaywsnggngtnttygtnggngaytggmgnccngargaygcngarmgngcngtnaarggngcnaargargcnggnttygayytnathgarytnaayytnwsngtnccngargargtngaygcngayytnacnaaraargtnytnmgngaytaygarytncargcnwsnggnwsnytnggnytnwsnmgngcnacngayathwsnwsnwsngayacngarathmgnmgnaayggnathaarytnytnwsnaaygcnytnaargcnytnaaygtngtnggnggnaartayttyathggngtnaayttyggngcnatggayaartaymgngarccnytnacngcngarcartggaarcaytgygtngcnwsnytnaargargtngcnwsngargcngcngaytayggnathgartayggnytngargtngtnaaymgntaygaracnaayathytnaayacngcncarcargcnaargarytngtnggngayathggnytngayaaygtnacnathcayytngayacntaycayatgaayathgargaraaywsnatggarcargcnathcargcngcnggnaayaarytnggntayathcayathggngarwsncaymgnggntayytnggnacnggnwsngtngayttyacnggnytnttymgnggnytngcngcnwsnggntayacnggnccnytnacnttygarwsnttywsnwsngcngtngtnwsnccnwsnytnwsnaayacnytntgygtntggmgngayytntgggaygayccngaygayytngcngtnaargcncayggnttyathgarwsnaaytgggcngcngcntaycarytntaywsnmgnccnaargcntggwsnaarccngtn

SEQ ID NO: 60 - protein, 341 aa, Coccomyxa subellipsoidea C-169
MSALKCPLLNKYPLTRPSLGKPKCGAVSTRAASQVVNAAAVLPKNLIGIHSGVFVGDWRPEDAERAVKGAKEAGFDLIELNLSVPEEVDADLTKKVLRDYELQASGSLGLSRATDISSSDTEIRRNGIKLLSNALKALNVVGGKYFIGVNFGAMDKYREPLTAEQWKHCVASLKEVASEAADYGIEYGLEVVNRYETNILNTAQQAKELVGDIGLDNVTIHLDTYHMNIEENSMEQAIQAAGNKLGYIHIGESHRGYLGTGSVDFTGLFRGLAASGYTGPLTFESFSSAVVSPSLSNTLCVWRDLWDDPDDLAVKAHGFIESNWAAAYQLYSRPKAWSKPV

SEQ ID NO: 61 - DNA, 867 bp, Artificial Sequence
  Synthetic
  misc_feature (12)..(12): n is a, c, g, or t
  misc_feature (21)..(21): n is a, c, g, or t
  misc_feature (24)..(24): n is a, c, g, or t
  misc_feature (27)..(27): n is a, c, g, or t
  misc_feature (33)..(33): n is a, c, g, or t
  misc_feature (36)..(36): n is a, c, g, or t
  misc_feature (48)..(48): n is a, c, g, or t
  misc_feature (54)..(54): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (78)..(78): n is a, c, g, or t
  misc_feature (87)..(87): n is a, c, g, or t
  misc_feature (90)..(90): n is a, c, g, or t
  misc_feature (99)..(99): n is a, c, g, or t
  misc_feature (111)..(111): n is a, c, g, or t
  misc_feature (114)..(114): n is a, c, g, or t
  misc_feature (123)..(123): n is a, c, g, or t
  misc_feature (129)..(129): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (156)..(156): n is a, c, g, or t
  misc_feature (159)..(159): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (210)..(210): n is a, c, g, or t
  misc_feature (216)..(216): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (231)..(231): n is a, c, g, or t
  misc_feature (234)..(234): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (270)..(270): n is a, c, g, or t
  misc_feature (273)..(273): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (312)..(312): n is a, c, g, or t
  misc_feature (315)..(315): n is a, c, g, or t
  misc_feature (324)..(324): n is a, c, g, or t
  misc_feature (327)..(327): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (381)..(381): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (408)..(408): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (441)..(441): n is a, c, g, or t
  misc_feature (444)..(444): n is a, c, g, or t
  misc_feature (450)..(450): n is a, c, g, or t
  misc_feature (459)..(459): n is a, c, g, or t
  misc_feature (465)..(465): n is a, c, g, or t
  misc_feature (468)..(468): n is a, c, g, or t
  misc_feature (474)..(474): n is a, c, g, or t
  misc_feature (477)..(477): n is a, c, g, or t
  misc_feature (480)..(480): n is a, c, g, or t
  misc_feature (486)..(486): n is a, c, g, or t
  misc_feature (489)..(489): n is a, c, g, or t
  misc_feature (498)..(498): n is a, c, g, or t
  misc_feature (501)..(501): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (522)..(522): n is a, c, g, or t
  misc_feature (525)..(525): n is a, c, g, or t
  misc_feature (540)..(540): n is a, c, g, or t
  misc_feature (564)..(564): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (612)..(612): n is a, c, g, or t
  misc_feature (621)..(621): n is a, c, g, or t
  misc_feature (627)..(627): n is a, c, g, or t
  misc_feature (633)..(633): n is a, c, g, or t
  misc_feature (636)..(636): n is a, c, g, or t
  misc_feature (642)..(642): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (705)..(705): n is a, c, g, or t
  misc_feature (708)..(708): n is a, c, g, or t
  misc_feature (714)..(714): n is a, c, g, or t
  misc_feature (723)..(723): n is a, c, g, or t
  misc_feature (729)..(729): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (777)..(777): n is a, c, g, or t
  misc_feature (783)..(783): n is a, c, g, or t
  misc_feature (798)..(798): n is a, c, g, or t
  misc_feature (804)..(804): n is a, c, g, or t
  misc_feature (807)..(807): n is a, c, g, or t
  misc_feature (810)..(810): n is a, c, g, or t
  misc_feature (816)..(816): n is a, c, g, or t
  misc_feature (822)..(822): n is a, c, g, or t
  misc_feature (831)..(831): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (855)..(855): n is a, c, g, or t
  misc_feature (861)..(861): n is a, c, g, or t
  misc_feature (864)..(864): n is a, c, g, or t
atgaayathggntgycayggnytngtntggacnggnaayttygaygcngarggnathmgnytngcngtnmgnaaracnaargargcnggnttygayytnathgarttyccnytnatggayccnttywsnttygaygtnwsngtngcnaargaygcnytngargartaygayytngcngtnwsngcnwsnytnggnytnwsngargcnacngaygtnacnwsnwsngayccngcnathgtngcngcnggngargcnytnytnytnaargcngtngaygtnytngcngayytnggnggncarcayttytgyggngtnathtaywsngcnatgaaraartayatggcnccngtnacngcngarggnytngcnwsnwsnaargcngcnathgcnmgngtngcngaycaygcngcngarmgnggngtnwsngtngcnytngargtngtnaaymgntaygaracnaaygtnytnaayacngcnmgncargcnytngartaygtngcngargtngaymgnccnaayytnggnathcayathgayacntaycayatgaayathgargarwsngayatgttygcnccngtnytngaygcngcnccngcnytnmgntaygtncayathggngarwsncaymgnggntayytnggnacnggnacngtngayttygayacnttyttyaargcnytnwsnmgnathggntaygayggnccnathgtnttygarwsnttywsnwsngcngtngtngcnccngayytnwsnmgnatgytnggnathtggmgnaayytntggaaygayaaygtngarytnggngcncaygcnaaygcntayathmgngayaarytngtngcngtngarwsnathmgnytncay

SEQ ID NO: 62 - protein, 289 aa, Microbacterium maritypicum
MNIGCHGLVWTGNFDAEGIRLAVRKTKEAGFDLIEFPLMDPFSFDVSVAKDALEEYDLAVSASLGLSEATDVTSSDPAIVAAGEALLLKAVDVLADLGGQHFCGVIYSAMKKYMAPVTAEGLASSKAAIARVADHAAERGVSVALEVVNRYETNVLNTARQALEYVAEVDRPNLGIHIDTYHMNIEESDMFAPVLDAAPALRYVHIGESHRGYLGTGTVDFDTFFKALSRIGYDGPIVFESFSSAVVAPDLSRMLGIWRNLWNDNVELGAHANAYIRDKLVAVESIRLH

SEQ ID NO: 63 - DNA, 867 bp, Artificial Sequence
  Synthetic
  misc_feature (12)..(12): n is a, c, g, or t
  misc_feature (21)..(21): n is a, c, g, or t
  misc_feature (24)..(24): n is a, c, g, or t
  misc_feature (27)..(27): n is a, c, g, or t
  misc_feature (33)..(33): n is a, c, g, or t
  misc_feature (36)..(36): n is a, c, g, or t
  misc_feature (48)..(48): n is a, c, g, or t
  misc_feature (54)..(54): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (78)..(78): n is a, c, g, or t
  misc_feature (87)..(87): n is a, c, g, or t
  misc_feature (90)..(90): n is a, c, g, or t
  misc_feature (99)..(99): n is a, c, g, or t
  misc_feature (111)..(111): n is a, c, g, or t
  misc_feature (114)..(114): n is a, c, g, or t
  misc_feature (123)..(123): n is a, c, g, or t
  misc_feature (129)..(129): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (156)..(156): n is a, c, g, or t
  misc_feature (159)..(159): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (210)..(210): n is a, c, g, or t
  misc_feature (216)..(216): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (231)..(231): n is a, c, g, or t
  misc_feature (234)..(234): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (270)..(270): n is a, c, g, or t
  misc_feature (273)..(273): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (312)..(312): n is a, c, g, or t
  misc_feature (315)..(315): n is a, c, g, or t
  misc_feature (324)..(324): n is a, c, g, or t
  misc_feature (327)..(327): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (381)..(381): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (408)..(408): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (441)..(441): n is a, c, g, or t
  misc_feature (444)..(444): n is a, c, g, or t
  misc_feature (450)..(450): n is a, c, g, or t
  misc_feature (459)..(459): n is a, c, g, or t
  misc_feature (465)..(465): n is a, c, g, or t
  misc_feature (468)..(468): n is a, c, g, or t
  misc_feature (474)..(474): n is a, c, g, or t
  misc_feature (477)..(477): n is a, c, g, or t
  misc_feature (480)..(480): n is a, c, g, or t
  misc_feature (486)..(486): n is a, c, g, or t
  misc_feature (489)..(489): n is a, c, g, or t
  misc_feature (498)..(498): n is a, c, g, or t
  misc_feature (501)..(501): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (522)..(522): n is a, c, g, or t
  misc_feature (525)..(525): n is a, c, g, or t
  misc_feature (540)..(540): n is a, c, g, or t
  misc_feature (564)..(564): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (612)..(612): n is a, c, g, or t
  misc_feature (621)..(621): n is a, c, g, or t
  misc_feature (627)..(627): n is a, c, g, or t
  misc_feature (633)..(633): n is a, c, g, or t
  misc_feature (636)..(636): n is a, c, g, or t
  misc_feature (642)..(642): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (705)..(705): n is a, c, g, or t
  misc_feature (708)..(708): n is a, c, g, or t
  misc_feature (714)..(714): n is a, c, g, or t
  misc_feature (723)..(723): n is a, c, g, or t
  misc_feature (729)..(729): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (777)..(777): n is a, c, g, or t
  misc_feature (783)..(783): n is a, c, g, or t
  misc_feature (798)..(798): n is a, c, g, or t
  misc_feature (804)..(804): n is a, c, g, or t
  misc_feature (807)..(807): n is a, c, g, or t
  misc_feature (810)..(810): n is a, c, g, or t
  misc_feature (816)..(816): n is a, c, g, or t
  misc_feature (822)..(822): n is a, c, g, or t
  misc_feature (831)..(831): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (855)..(855): n is a, c, g, or t
  misc_feature (861)..(861): n is a, c, g, or t
  misc_feature (864)..(864): n is a, c, g, or t
atgaayathggntgycayggnytngtntggacnggnaayttygaygcngarggnathmgnytngcngtnmgnaaracnaargargcnggnttygayytnathgarttyccnytnatggayccnttywsnttygaygtnwsngtngcnaargaygcnytngargartaygayytngcngtnwsngcnwsnytnggnytnwsngargcnacngaygtnacnwsnwsngayccnacnathgtngcngcnggngargcnytnytnytnaargcngtngaygtnytngcngayytnggnggncarcayttytgyggngtnathtaywsngcnatgaaraartayatggarccngtnacngcngarggnytngcnwsnwsnaargcngcnathgcnmgngtngcngaycaygcngcngarmgnggngtnwsngtngcnytngargtngtnaaymgntaygaracnaaygtnytnaayacngcnmgncargcnytngartaygtngcngargtngaymgnccnaayytnggnathcayathgayacntaycayatgaayathgargarwsngayatgttygcnccngtnytngaygcngcnccngcnytnmgntaygtncayathggngarwsncaymgnggntayytnggnacnggnacngtngayttygayacnttyttyaargcnytnggnmgnathggntaygayggnccnathgtnttygarwsnttywsnwsngcngtngtngcnccngayytnwsnmgnatgytnggnathtggmgnaayytntggaaygayaaygtngarytnggngcncaygcnaaygcntayathmgngayaarytngtngcngtngarwsnathmgnytncay

SEQ ID NO: 64 - protein, 289 aa, Microbacterium sp.
MNIGCHGLVWTGNFDAEGIRLAVRKTKEAGFDLIEFPLMDPFSFDVSVAKDALEEYDLAVSASLGLSEATDVTSSDPTIVAAGEALLLKAVDVLADLGGQHFCGVIYSAMKKYMEPVTAEGLASSKAAIARVADHAAERGVSVALEVVNRYETNVLNTARQALEYVAEVDRPNLGIHIDTYHMNIEESDMFAPVLDAAPALRYVHIGESHRGYLGTGTVDFDTFFKALGRIGYDGPIVFESFSSAVVAPDLSRMLGIWRNLWNDNVELGAHANAYIRDKLVAVESIRLH

SEQ ID NO: 65 - DNA, 867 bp, Artificial Sequence
  Synthetic
  misc_feature (12)..(12): n is a, c, g, or t
  misc_feature (21)..(21): n is a, c, g, or t
  misc_feature (24)..(24): n is a, c, g, or t
  misc_feature (27)..(27): n is a, c, g, or t
  misc_feature (33)..(33): n is a, c, g, or t
  misc_feature (36)..(36): n is a, c, g, or t
  misc_feature (48)..(48): n is a, c, g, or t
  misc_feature (54)..(54): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (78)..(78): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (99)..(99): n is a, c, g, or t
  misc_feature (111)..(111): n is a, c, g, or t
  misc_feature (114)..(114): n is a, c, g, or t
  misc_feature (123)..(123): n is a, c, g, or t
  misc_feature (129)..(129): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (156)..(156): n is a, c, g, or t
  misc_feature (159)..(159): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (210)..(210): n is a, c, g, or t
  misc_feature (216)..(216): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (231)..(231): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (270)..(270): n is a, c, g, or t
  misc_feature (273)..(273): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (312)..(312): n is a, c, g, or t
  misc_feature (315)..(315): n is a, c, g, or t
  misc_feature (324)..(324): n is a, c, g, or t
  misc_feature (327)..(327): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (381)..(381): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (441)..(441): n is a, c, g, or t
  misc_feature (444)..(444): n is a, c, g, or t
  misc_feature (450)..(450): n is a, c, g, or t
  misc_feature (459)..(459): n is a, c, g, or t
  misc_feature (465)..(465): n is a, c, g, or t
  misc_feature (468)..(468): n is a, c, g, or t
  misc_feature (474)..(474): n is a, c, g, or t
  misc_feature (477)..(477): n is a, c, g, or t
  misc_feature (480)..(480): n is a, c, g, or t
  misc_feature (486)..(486): n is a, c, g, or t
  misc_feature (489)..(489): n is a, c, g, or t
  misc_feature (492)..(492): n is a, c, g, or t
  misc_feature (501)..(501): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (522)..(522): n is a, c, g, or t
  misc_feature (525)..(525): n is a, c, g, or t
  misc_feature (540)..(540): n is a, c, g, or t
  misc_feature (564)..(564): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (612)..(612): n is a, c, g, or t
  misc_feature (621)..(621): n is a, c, g, or t
  misc_feature (627)..(627): n is a, c, g, or t
  misc_feature (633)..(633): n is a, c, g, or t
  misc_feature (636)..(636): n is a, c, g, or t
  misc_feature (642)..(642): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (705)..(705): n is a, c, g, or t
  misc_feature (708)..(708): n is a, c, g, or t
  misc_feature (714)..(714): n is a, c, g, or t
  misc_feature (723)..(723): n is a, c, g, or t
  misc_feature (729)..(729): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (777)..(777): n is a, c, g, or t
  misc_feature (783)..(783): n is a, c, g, or t
  misc_feature (804)..(804): n is a, c, g, or t
  misc_feature (807)..(807): n is a, c, g, or t
  misc_feature (810)..(810): n is a, c, g, or t
  misc_feature (816)..(816): n is a, c, g, or t
  misc_feature (822)..(822): n is a, c, g, or t
  misc_feature (831)..(831): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (855)..(855): n is a, c, g, or t
  misc_feature (861)..(861): n is a, c, g, or t
  misc_feature (864)..(864): n is a, c, g, or t
atgaayathggntgycayggnytngtntggacnggnaayttygaygcngarggnathmgnytngcngtncayaaracnmgngargcnggnttygayytnathgarttyccnytnatggayccnttyacnttygaygtnwsngtngcnaargaygcnytngargartaygayytngcngtnwsngcnwsnytnggnytntaygargaracngaygtnacnwsngcngayccngcngtngcngcngcnggngargcnytnytnathaargcngtngaygtnytngcngayytnggnggngarcayttytgyggngtnathtaywsngcnatgaaraartayatggarccngtnacnccngarggnytngcnwsnwsnaargcngcnathgcnmgngtngcngaycaygcngcngtnmgnggngtnwsngtnwsnytngargtngtnaaymgntaygaracnaaygtnytnaayacngcnmgncargcnytngcntayathgcngargtngaymgnccnaayytnggnathcayathgayacntaycayatgaayathgargarwsngayatgttyacnccngtnytngaygcngcnccngcnytnmgntaygtncayathggngarwsncaymgnggntayytnggnacnggnacngtngayttygayacnttyttyaargcnytnggnmgnathggntayaayggnccnathgtnttygarwsnttywsnwsngcngtngtngcnccngayytnwsnmgnatgytnggnathtggmgnaayytntggaaygayaaygaygarytnggngcncaygcnaaygcntayathmgngayaarytngtngcngtngaywsnathmgnytncay

SEQ ID NO: 66 - protein, 289 aa, Microbacterium sp. UCD-TDU
MNIGCHGLVWTGNFDAEGIRLAVHKTREAGFDLIEFPLMDPFTFDVSVAKDALEEYDLAVSASLGLYEETDVTSADPAVAAAGEALLIKAVDVLADLGGEHFCGVIYSAMKKYMEPVTPEGLASSKAAIARVADHAAVRGVSVSLEVVNRYETNVLNTARQALAYIAEVDRPNLGIHIDTYHMNIEESDMFTPVLDAAPALRYVHIGESHRGYLGTGTVDFDTFFKALGRIGYNGPIVFESFSSAVVAPDLSRMLGIWRNLWNDNDELGAHANAYIRDKLVAVDSIRLH

SEQ ID NO: 67 - DNA, 867 bp, Artificial Sequence
  Synthetic
  misc_feature (12)..(12): n is a, c, g, or t
  misc_feature (21)..(21): n is a, c, g, or t
  misc_feature (24)..(24): n is a, c, g, or t
  misc_feature (27)..(27): n is a, c, g, or t
  misc_feature (33)..(33): n is a, c, g, or t
  misc_feature (36)..(36): n is a, c, g, or t
  misc_feature (39)..(39): n is a, c, g, or t
  misc_feature (48)..(48): n is a, c, g, or t
  misc_feature (54)..(54): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (78)..(78): n is a, c, g, or t
  misc_feature (87)..(87): n is a, c, g, or t
  misc_feature (90)..(90): n is a, c, g, or t
  misc_feature (99)..(99): n is a, c, g, or t
  misc_feature (111)..(111): n is a, c, g, or t
  misc_feature (114)..(114): n is a, c, g, or t
  misc_feature (123)..(123): n is a, c, g, or t
  misc_feature (129)..(129): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (171)..(171): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (210)..(210): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (231)..(231): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (270)..(270): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (312)..(312): n is a, c, g, or t
  misc_feature (315)..(315): n is a, c, g, or t
  misc_feature (324)..(324): n is a, c, g, or t
  misc_feature (327)..(327): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (381)..(381): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (408)..(408): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (441)..(441): n is a, c, g, or t
  misc_feature (444)..(444): n is a, c, g, or t
  misc_feature (450)..(450): n is a, c, g, or t
  misc_feature (459)..(459): n is a, c, g, or t
  misc_feature (465)..(465): n is a, c, g, or t
  misc_feature (468)..(468): n is a, c, g, or t
  misc_feature (474)..(474): n is a, c, g, or t
  misc_feature (477)..(477): n is a, c, g, or t
  misc_feature (480)..(480): n is a, c, g, or t
  misc_feature (486)..(486): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (501)..(501): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (522)..(522): n is a, c, g, or t
  misc_feature (525)..(525): n is a, c, g, or t
  misc_feature (534)..(534): n is a, c, g, or t
  misc_feature (540)..(540): n is a, c, g, or t
  misc_feature (564)..(564): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (612)..(612): n is a, c, g, or t
  misc_feature (621)..(621): n is a, c, g, or t
  misc_feature (627)..(627): n is a, c, g, or t
  misc_feature (633)..(633): n is a, c, g, or t
  misc_feature (636)..(636): n is a, c, g, or t
  misc_feature (642)..(642): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (705)..(705): n is a, c, g, or t
  misc_feature (708)..(708): n is a, c, g, or t
  misc_feature (714)..(714): n is a, c, g, or t
  misc_feature (723)..(723): n is a, c, g, or t
  misc_feature (729)..(729): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (777)..(777): n is a, c, g, or t
  misc_feature (783)..(783): n is a, c, g, or t
  misc_feature (789)..(789): n is a, c, g, or t
  misc_feature (804)..(804): n is a, c, g, or t
  misc_feature (807)..(807): n is a, c, g, or t
  misc_feature (810)..(810): n is a, c, g, or t
  misc_feature (816)..(816): n is a, c, g, or t
  misc_feature (822)..(822): n is a, c, g, or t
  misc_feature (831)..(831): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (855)..(855): n is a, c, g, or t
  misc_feature (861)..(861): n is a, c, g, or t
  misc_feature (864)..(864): n is a, c, g, or t
atgaayathggntgycayggnytngtntggacnggnacnttygaygcngayggnathmgnytngcngtngaraaracnaarcargcnggnttygayytnathgarttyccnytnatggayccnttywsnttygaygtngcngcngcnmgngcngcnytngcngarcayggnytngcngtnwsngcnwsnytnggnytnwsnaaygaracngayathacnwsnwsngayccngtngtngtngcngcnggngargcnytnytnytnmgngcnathgaygtnytngcngarytnggnggnacncayttytgyggngtnathtaywsngcnatgaaraartayatggayccngtnacnccngarggnytngcnwsnwsnmgnmgnacnathgcnmgngtngcngaycaygcngcngarmgnggngtnwsngtnwsnytngargtngtnaaymgntaygaracnaaygtnytnaayacngcnmgncargcnytngcntayytnggngargtngaymgnccnaayytnggnathcayytngayacntaycayatgaayathgargarwsngayatgttygcnccngtnytngaygcngcnccngcnytnmgntaygtncayathggngarwsncaymgnggntayytnggnacnggnacngtngayttygayacnttyttyaargcnytnggnmgnathggntaygayggnccnathgtnttygarwsnttywsnwsngcngtngtngcnccngayytnwsnmgnatgytnggnathtggmgnaayytntggacngayaaycaygarytnggngcncaygcnaaygcntayathmgngayaarytngtngcngtngaywsnathmgnytncay

SEQ ID NO: 68 - protein, 289 aa, Microbacterium paraoxydans
MNIGCHGLVWTGTFDADGIRLAVEKTKQAGFDLIEFPLMDPFSFDVAAARAALAEHGLAVSASLGLSNETDITSSDPVVVAAGEALLLRAIDVLAELGGTHFCGVIYSAMKKYMDPVTPEGLASSRRTIARVADHAAERGVSVSLEVVNRYETNVLNTARQALAYLGEVDRPNLGIHLDTYHMNIEESDMFAPVLDAAPALRYVHIGESHRGYLGTGTVDFDTFFKALGRIGYDGPIVFESFSSAVVAPDLSRMLGIWRNLWTDNHELGAHANAYIRDKLVAVDSIRLH

SEQ ID NO: 69 - DNA, 867 bp, Artificial Sequence
  Synthetic
  misc_feature (12)..(12): n is a, c, g, or t
  misc_feature (21)..(21): n is a, c, g, or t
  misc_feature (24)..(24): n is a, c, g, or t
  misc_feature (27)..(27): n is a, c, g, or t
  misc_feature (33)..(33): n is a, c, g, or t
  misc_feature (36)..(36): n is a, c, g, or t
  misc_feature (39)..(39): n is a, c, g, or t
  misc_feature (48)..(48): n is a, c, g, or t
  misc_feature (54)..(54): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (78)..(78): n is a, c, g, or t
  misc_feature (87)..(87): n is a, c, g, or t
  misc_feature (90)..(90): n is a, c, g, or t
  misc_feature (99)..(99): n is a, c, g, or t
  misc_feature (111)..(111): n is a, c, g, or t
  misc_feature (114)..(114): n is a, c, g, or t
  misc_feature (123)..(123): n is a, c, g, or t
  misc_feature (129)..(129): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (210)..(210): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (231)..(231): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (270)..(270): n is a, c, g, or t
  misc_feature (273)..(273): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (312)..(312): n is a, c, g, or t
  misc_feature (315)..(315): n is a, c, g, or t
  misc_feature (324)..(324): n is a, c, g, or t
  misc_feature (327)..(327): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (381)..(381): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (408)..(408): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (441)..(441): n is a, c, g, or t
  misc_feature (444)..(444): n is a, c, g, or t
  misc_feature (450)..(450): n is a, c, g, or t
  misc_feature (459)..(459): n is a, c, g, or t
  misc_feature (465)..(465): n is a, c, g, or t
  misc_feature (468)..(468): n is a, c, g, or t
  misc_feature (474)..(474): n is a, c, g, or t
  misc_feature (477)..(477): n is a, c, g, or t
  misc_feature (480)..(480): n is a, c, g, or t
  misc_feature (486)..(486): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (501)..(501): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (522)..(522): n is a, c, g, or t
  misc_feature (525)..(525): n is a, c, g, or t
  misc_feature (534)..(534): n is a, c, g, or t
  misc_feature (540)..(540): n is a, c, g, or t
  misc_feature (564)..(564): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (612)..(612): n is a, c, g, or t
  misc_feature (621)..(621): n is a, c, g, or t
  misc_feature (627)..(627): n is a, c, g, or t
  misc_feature (633)..(633): n is a, c, g, or t
  misc_feature (636)..(636): n is a, c, g, or t
  misc_feature (642)..(642): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (705)..(705): n is a, c, g, or t
  misc_feature (708)..(708): n is a, c, g, or t
  misc_feature (714)..(714): n is a, c, g, or t
  misc_feature (723)..(723): n is a, c, g, or t
  misc_feature (729)..(729): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (777)..(777): n is a, c, g, or t
  misc_feature (783)..(783): n is a, c, g, or t
  misc_feature (789)..(789): n is a, c, g, or t
  misc_feature (804)..(804): n is a, c, g, or t
  misc_feature (807)..(807): n is a, c, g, or t
  misc_feature (810)..(810): n is a, c, g, or t
  misc_feature (816)..(816): n is a, c, g, or t
  misc_feature (822)..(822): n is a, c, g, or t
  misc_feature (831)..(831): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (855)..(855): n is a, c, g, or t
  misc_feature (861)..(861): n is a, c, g, or t
  misc_feature (864)..(864): n is a, c, g, or t
atgaayathggntgycayggnytngtntggacnggnwsnttygaygcngayggnathmgnytngcngtngaraaracnaarcargcnggnttygayytnathgarttyccnytnatggayccnttywsnttygaygtngcngcngcnaarwsngcnytngcngarcaygayytngcngtnwsngcnwsnytnggnytnwsngarwsnacngayathacnwsnggngayccngaracngtngcngcnggngargarytnytnytnmgngcngtngaygtnytngcngarytnggnggnacncayttytgyggngtnathtaywsngcnatgaaraartayatgcarccngcnacngcngarggnytngcnwsnwsnmgnmgnacnathgcnmgngtngcngaycaygcngcngarmgnggngtnwsngtnwsnytngargtngtnaaymgntaygaracnaaygtnytnaayacngcnmgncargcnytngcntayytngcngargtngaymgnccnaayytnggnathcayytngayacntaycayatgaayathgargarwsngayatgttygcnccngtnytngaygcngcnccngcnytnmgntaygtncayathggngarwsncaymgnggntayytnggnacnggnacngtngayttygayacnttyttyaargcnytnggnmgnathggntaygayggnccnathgtnttygarwsnttywsnwsngcngtngtngcnccngayytnwsnmgnatgytnggnathtggmgnaayytntggwsngayaaygaygarytnggngcncaygcnaaygcntayathmgngayaarytngtngcngtngaywsnathmgnytncay

SEQ ID NO: 70 - protein, 289 aa, Microbacterium barkeri
MNIGCHGLVWTGSFDADGIRLAVEKTKQAGFDLIEFPLMDPFSFDVAAAKSALAEHDLAVSASLGLSESTDITSGDPETVAAGEELLLRAVDVLAELGGTHFCGVIYSAMKKYMQPATAEGLASSRRTIARVADHAAERGVSVSLEVVNRYETNVLNTARQALAYLAEVDRPNLGIHLDTYHMNIEESDMFAPVLDAAPALRYVHIGESHRGYLGTGTVDFDTFFKALGRIGYDGPIVFESFSSAVVAPDLSRMLGIWRNLWSDNDELGAHANAYIRDKLVAVDSIRLH

SEQ ID NO: 71 - DNA, 867 bp, Artificial Sequence
  Synthetic
  misc_feature (12)..(12): n is a, c, g, or t
  misc_feature (21)..(21): n is a, c, g, or t
  misc_feature (24)..(24): n is a, c, g, or t
  misc_feature (27)..(27): n is a, c, g, or t
  misc_feature (33)..(33): n is a, c, g, or t
  misc_feature (36)..(36): n is a, c, g, or t
  misc_feature (39)..(39): n is a, c, g, or t
  misc_feature (48)..(48): n is a, c, g, or t
  misc_feature (54)..(54): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (78)..(78): n is a, c, g, or t
  misc_feature (84)..(84): n is a, c, g, or t
  misc_feature (87)..(87): n is a, c, g, or t
  misc_feature (90)..(90): n is a, c, g, or t
  misc_feature (99)..(99): n is a, c, g, or t
  misc_feature (111)..(111): n is a, c, g, or t
  misc_feature (114)..(114): n is a, c, g, or t
  misc_feature (123)..(123): n is a, c, g, or t
  misc_feature (129)..(129): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (153)..(153): n is a, c, g, or t
  misc_feature (156)..(156): n is a, c, g, or t
  misc_feature (171)..(171): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (210)..(210): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (231)..(231): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (270)..(270): n is a, c, g, or t
  misc_feature (273)..(273): n is a, c, g, or t
  misc_feature (282)..(282): n is a, c, g, or t
  misc_feature (285)..(285): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (312)..(312): n is a, c, g, or t
  misc_feature (315)..(315): n is a, c, g, or t
  misc_feature (324)..(324): n is a, c, g, or t
  misc_feature (327)..(327): n is a, c, g, or t
  misc_feature (333)..(333): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (384)..(384): n is a, c, g, or t
  misc_feature (390)..(390): n is a, c, g, or t
  misc_feature (399)..(399): n is a, c, g, or t
  misc_feature (408)..(408): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (441)..(441): n is a, c, g, or t
  misc_feature (444)..(444): n is a, c, g, or t
  misc_feature (450)..(450): n is a, c, g, or t
  misc_feature (459)..(459): n is a, c, g, or t
  misc_feature (465)..(465): n is a, c, g, or t
  misc_feature (468)..(468): n is a, c, g, or t
  misc_feature (474)..(474): n is a, c, g, or t
  misc_feature (477)..(477): n is a, c, g, or t
  misc_feature (480)..(480): n is a, c, g, or t
  misc_feature (486)..(486): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (501)..(501): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (522)..(522): n is a, c, g, or t
  misc_feature (525)..(525): n is a, c, g, or t
  misc_feature (528)..(528): n is a, c, g, or t
  misc_feature (534)..(534): n is a, c, g, or t
  misc_feature (540)..(540): n is a, c, g, or t
  misc_feature (564)..(564): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (603)..(603): n is a, c, g, or t
  misc_feature (612)..(612): n is a, c, g, or t
  misc_feature (621)..(621): n is a, c, g, or t
  misc_feature (627)..(627): n is a, c, g, or t
  misc_feature (633)..(633): n is a, c, g, or t
  misc_feature (636)..(636): n is a, c, g, or t
  misc_feature (642)..(642): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (705)..(705): n is a, c, g, or t
  misc_feature (708)..(708): n is a, c, g, or t
  misc_feature (714)..(714): n is a, c, g, or t
  misc_feature (723)..(723): n is a, c, g, or t
  misc_feature (729)..(729): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (777)..(777): n is a, c, g, or t
  misc_feature (783)..(783): n is a, c, g, or t
  misc_feature (789)..(789): n is a, c, g, or t
  misc_feature (798)..(798): n is a, c, g, or t
  misc_feature (804)..(804): n is a, c, g, or t
  misc_feature (807)..(807): n is a, c, g, or t
  misc_feature (810)..(810): n is a, c, g, or t
  misc_feature (816)..(816): n is a, c, g, or t
  misc_feature (822)..(822): n is a, c, g, or t
  misc_feature (831)..(831): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (855)..(855): n is a, c, g, or t
  misc_feature (861)..(861): n is a, c, g, or t
  misc_feature (864)..(864): n is a, c, g, or t
atgaarathggntgycayggnytngtntggacnggnwsnttygaygcngayggnathmgnytngcngtngaraaracnaargcngcnggnttygayytnathgarttyccnytnatggayccnttywsnttygaygtngcngcngcnaargcngcnathgargarcayggnytngcngtnwsngcnwsnytnggnytnwsngargcnacngayathacnwsngcngayccngcngtngtngcngcnggngargcnytnytnytnmgngcngtngayathgtngcngarytnggnggngarcayttytgyggngtnathtaywsngcnatgmgnaartayatggayccngtnacnccngarggnytngtnwsnwsnaarcaracnathgcnaarathgcngaycaygcnwsngarmgnggngtnacngtnwsnytngargtngtnaaymgntaygarwsnaaygtnytnaayacnggnmgncargcnytngcntaygtngcngaygtnaaymgnccnaayytnggngtncayytngayacntaycayatgaayathgargarwsngayatgttygcnccngtnytngayacngcngcnaarytnaaytaygtncayathggngarwsncaymgnggntayytnggnacnggnacngtngayttygayaayttyttyaargcnytnggnmgnathgayttycarggnccnathgtnttygarwsnttywsnwsngcngtngtngcnccngayytnwsnmgnatgytnggnathtggmgnaayytntggacngayaaygtngarytnggngcncaygcnaaygcnttyathmgngayaarytngtngcngtngaywsnathmgnytncay

SEQ ID NO: 72 - protein, 289 aa, Microbacterium sp. CH12i
MKIGCHGLVWTGSFDADGIRLAVEKTKAAGFDLIEFPLMDPFSFDVAAAKAAIEEHGLAVSASLGLSEATDITSADPAVVAAGEALLLRAVDIVAELGGEHFCGVIYSAMRKYMDPVTPEGLVSSKQTIAKIADHASERGVTVSLEVVNRYESNVLNTGRQALAYVADVNRPNLGVHLDTYHMNIEESDMFAPVLDTAAKLNYVHIGESHRGYLGTGTVDFDNFFKALGRIDFQGPIVFESFSSAVVAPDLSRMLGIWRNLWTDNVELGAHANAFIRDKLVAVDSIRLH

SEQ ID NO: 73 - DNA, 870 bp, Artificial Sequence
  Synthetic
  misc_feature (15)..(15): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (42)..(42): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (63)..(63): n is a, c, g, or t
  misc_feature (69)..(69): n is a, c, g, or t
  misc_feature (72)..(72): n is a, c, g, or t
  misc_feature (81)..(81): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (114)..(114): n is a, c, g, or t
  misc_feature (117)..(117): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (210)..(210): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (270)..(270): n is a, c, g, or t
  misc_feature (273)..(273): n is a, c, g, or t
  misc_feature (276)..(276): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (315)..(315): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (372)..(372): n is a, c, g, or t
  misc_feature (378)..(378): n is a, c, g, or t
  misc_feature (384)..(384): n is a, c, g, or t
  misc_feature (387)..(387): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (501)..(501): n is a, c, g, or t
  misc_feature (504)..(504): n is a, c, g, or t
  misc_feature (507)..(507): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (522)..(522): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (672)..(672): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (693)..(693): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (750)..(750): n is a, c, g, or t
  misc_feature (756)..(756): n is a, c, g, or t
  misc_feature (759)..(759): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (792)..(792): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (825)..(825): n is a, c, g, or t
  misc_feature (834)..(834): n is a, c, g, or t
  misc_feature (846)..(846): n is a, c, g, or t
  misc_feature (849)..(849): n is a, c, g, or t
  misc_feature (855)..(855): n is a, c, g, or t
  misc_feature (858)..(858): n is a, c, g, or t
  misc_feature (864)..(864): n is a, c, g, or t
atgatgcarathggntgycayggnytngtntggacnggnacntaygaygcngcnggnathmgncaygcngtncaraarwsnaargargcnggnttygayytnathgarttyccnytnatggayccnttyacnttygaygtnggngcngcnmgngcngcnytngaygarttyggnatggcngcnacnggnwsnytnggnytngaygarwsnacngaygtnwsnwsngargaygarwsngcngtnmgngcnggngargcnytnytngarmgngcngtngaygtnytngcngarytnggngcngcncayytntgyggnathathtaywsngcnatgmgnaartayatggarccngcnacnccnmgnggnathgcnaaywsncargcngtnathggnmgnathgcngaymgngcngcncargcnggnathaargtnwsngtngargtnacnaaymgntaygarwsnaaygtnytnaayacngcnmgncargcnmgngarttygtngcnggngcnggnaayggnggngtnggngtncayytngayacntaycayatgaayathgargaracngayatgttywsnccngtnytngayacngcngaycarytnwsntaygtncayathggngarwsncaymgnggntayytnggnacnggnwsngtngayttygaywsnttyttymgngcnytnacnmgnathggntaygayggnccngtngtnttygarwsnttywsnwsngcngtngtngcnccngayytnwsnmgnatgytnggnathtggmgnaayytntggwsngaywsngargarytnggngcncaygcnaaygcnttyathmgngayaaratgacngcnatggcnwsnatgwsncaycay

SEQ ID NO: 74 - protein, 290 aa, Geodermatophilaceae bacterium URHB0062
MMQIGCHGLVWTGTYDAAGIRHAVQKSKEAGFDLIEFPLMDPFTFDVGAARAALDEFGMAATGSLGLDESTDVSSEDESAVRAGEALLERAVDVLAELGAAHLCGIIYSAMRKYMEPATPRGIANSQAVIGRIADRAAQAGIKVSVEVTNRYESNVLNTARQAREFVAGAGNGGVGVHLDTYHMNIEETDMFSPVLDTADQLSYVHIGESHRGYLGTGSVDFDSFFRALTRIGYDGPVVFESFSSAVVAPDLSRMLGIWRNLWSDSEELGAHANAFIRDKMTAMASMSHH

SEQ ID NO: 75 - DNA, 876 bp, Artificial Sequence
  Synthetic
  misc_feature (6)..(6): n is a, c, g, or t
  misc_feature (9)..(9): n is a, c, g, or t
  misc_feature (12)..(12): n is a, c, g, or t
  misc_feature (15)..(15): n is a, c, g, or t
  misc_feature (21)..(21): n is a, c, g, or t
  misc_feature (30)..(30): n is a, c, g, or t
  misc_feature (33)..(33): n is a, c, g, or t
  misc_feature (36)..(36): n is a, c, g, or t
  misc_feature (42)..(42): n is a, c, g, or t
  misc_feature (45)..(45): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (84)..(84): n is a, c, g, or t
  misc_feature (87)..(87): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (108)..(108): n is a, c, g, or t
  misc_feature (120)..(120): n is a, c, g, or t
  misc_feature (123)..(123): n is a, c, g, or t
  misc_feature (132)..(132): n is a, c, g, or t
  misc_feature (138)..(138): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (210)..(210): n is a, c, g, or t
  misc_feature (219)..(219): n is a, c, g, or t
  misc_feature (225)..(225): n is a, c, g, or t
  misc_feature (228)..(228): n is a, c, g, or t
  misc_feature (231)..(231): n is a, c, g, or t
  misc_feature (240)..(240): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (267)..(267): n is a, c, g, or t
  misc_feature (270)..(270): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (303)..(303): n is a, c, g, or t
  misc_feature (306)..(306): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (324)..(324): n is a, c, g, or t
  misc_feature (327)..(327): n is a, c, g, or t
  misc_feature (333)..(333): n is a, c, g, or t
  misc_feature (336)..(336): n is a, c, g, or t
  misc_feature (342)..(342): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (363)..(363): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (384)..(384): n is a, c, g, or t
  misc_feature (393)..(393): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (417)..(417): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (444)..(444): n is a, c, g, or t
  misc_feature (450)..(450): n is a, c, g, or t
  misc_feature (453)..(453): n is a, c, g, or t
  misc_feature (459)..(459): n is a, c, g, or t
  misc_feature (468)..(468): n is a, c, g, or t
  misc_feature (474)..(474): n is a, c, g, or t
  misc_feature (477)..(477): n is a, c, g, or t
  misc_feature (483)..(483): n is a, c, g, or t
  misc_feature (486)..(486): n is a, c, g, or t
  misc_feature (489)..(489): n is a, c, g, or t
  misc_feature (495)..(495): n is a, c, g, or t
  misc_feature (498)..(498): n is a, c, g, or t
  misc_feature (501)..(501): n is a, c, g, or t
  misc_feature (507)..(507): n is a, c, g, or t
  misc_feature (510)..(510): n is a, c, g, or t
  misc_feature (513)..(513): n is a, c, g, or t
  misc_feature (516)..(516): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (534)..(534): n is a, c, g, or t
  misc_feature (537)..(537): n is a, c, g, or t
  misc_feature (543)..(543): n is a, c, g, or t
  misc_feature (549)..(549): n is a, c, g, or t
  misc_feature (573)..(573): n is a, c, g, or t
  misc_feature (579)..(579): n is a, c, g, or t
  misc_feature (588)..(588): n is a, c, g, or t
  misc_feature (594)..(594): n is a, c, g, or t
  misc_feature (600)..(600): n is a, c, g, or t
  misc_feature (603)..(603): n is a, c, g, or t
  misc_feature (609)..(609): n is a, c, g, or t
  misc_feature (612)..(612): n is a, c, g, or t
  misc_feature (615)..(615): n is a, c, g, or t
  misc_feature (621)..(621): n is a, c, g, or t
  misc_feature (630)..(630): n is a, c, g, or t
  misc_feature (636)..(636): n is a, c, g, or t
  misc_feature (642)..(642): n is a, c, g, or t
  misc_feature (645)..(645): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (663)..(663): n is a, c, g, or t
  misc_feature (666)..(666): n is a, c, g, or t
  misc_feature (678)..(678): n is a, c, g, or t
  misc_feature (681)..(681): n is a, c, g, or t
  misc_feature (687)..(687): n is a, c, g, or t
  misc_feature (690)..(690): n is a, c, g, or t
  misc_feature (693)..(693): n is a, c, g, or t
  misc_feature (699)..(699): n is a, c, g, or t
  misc_feature (705)..(705): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (723)..(723): n is a, c, g, or t
  misc_feature (732)..(732): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (762)..(762): n is a, c, g, or t
  misc_feature (765)..(765): n is a, c, g, or t
  misc_feature (771)..(771): n is a, c, g, or t
  misc_feature (774)..(774): n is a, c, g, or t
  misc_feature (777)..(777): n is a, c, g, or t
  misc_feature (786)..(786): n is a, c, g, or t
  misc_feature (792)..(792): n is a, c, g, or t
  misc_feature (798)..(798): n is a, c, g, or t
  misc_feature (804)..(804): n is a, c, g, or t
  misc_feature (813)..(813): n is a, c, g, or t
  misc_feature (816)..(816): n is a, c, g, or t
  misc_feature (819)..(819): n is a, c, g, or t
  misc_feature (825)..(825): n is a, c, g, or t
  misc_feature (831)..(831): n is a, c, g, or t
  misc_feature (840)..(840): n is a, c, g, or t
  misc_feature (852)..(852): n is a, c, g, or t
  misc_feature (855)..(855): n is a, c, g, or t
  misc_feature (858)..(858): n is a, c, g, or t
  misc_feature (861)..(861): n is a, c, g, or t
  misc_feature (864)..(864): n is a, c, g, or t
  misc_feature (873)..(873): n is a, c, g, or t
atgacnggnwsnccnathggntgycaygcnytngtntggacnggngayttygaygcngcnggnathacnwsnwsnathgaymgnacnaargcngcnggnttygayytnathgarttyccnytnatggarccngarwsnttygaywsnacngtngcnmgnmgngcnytncargaygcnggnytnwsngcnacngcnwsnytnggnytnccngarcaygcngaygtnwsnwsngaygayccngargtngtngcngcnggngcnaarytnytnmgnacngcnytngarmgnacngcngaratgggnggnacngtnytntgyggngtnytntayggnwsnatgmgnaarcayytngcnccnatgwsngaymgnggnmgngcnaaywsnathgargcnathcaymgnytngcngaycargcncargcnytnggngtnmgnytnwsnytngargtngtnaaymgntaygarwsnaayytnytnaayacnggnmgngaygcnytnmgnttyytnacnggngtngaycayccnwsngtnwsngtncayytngayacntaycayatgaayathgargarwsngayytnttycarccnttyytngayacnggngarmgnytnggntaygtncayathggngarwsncaymgnggntayytnggnacnggnwsngtngayttygaywsngcnttymgngcnytngaymgnathggntayacnggnccnathgtnttygarwsnttywsnwsngcngtngtnwsngcnacnytnwsnaayacnytnggnathtggmgnaayytntggacngaywsngaygayytnggngcncaygcnaaymgnttyathmgngaycayathgcngcngtnmgnacnathgarytncay

SEQ ID NO: 76 - protein, 292 aa, Nakamurella lacteal
MTGSPIGCHALVWTGDFDAAGITSSIDRTKAAGFDLIEFPLMEPESFDSTVARRALQDAGLSATASLGLPEHADVSSDDPEVVAAGAKLLRTALERTAEMGGTVLCGVLYGSMRKHLAPMSDRGRANSIEAIHRLADQAQALGVRLSLEVVNRYESNLLNTGRDALRFLTGVDHPSVSVHLDTYHMNIEESDLFQPFLDTGERLGYVHIGESHRGYLGTGSVDFDSAFRALDRIGYTGPIVFESFSSAVVSATLSNTLGIWRNLWTDSDDLGAHANRFIRDHIAAVRTIELH

SEQ ID NO: 77 - DNA, 870 bp, Artificial Sequence
  Synthetic
  misc_feature (6)..(6): n is a, c, g, or t
  misc_feature (12)..(12): n is a, c, g, or t
  misc_feature (15)..(15): n is a, c, g, or t
  misc_feature (21)..(21): n is a, c, g, or t
  misc_feature (24)..(24): n is a, c, g, or t
  misc_feature (27)..(27): n is a, c, g, or t
  misc_feature (33)..(33): n is a, c, g, or t
  misc_feature (36)..(36): n is a, c, g, or t
  misc_feature (39)..(39): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (75)..(75): n is a, c, g, or t
  misc_feature (78)..(78): n is a, c, g, or t
  misc_feature (87)..(87): n is a, c, g, or t
  misc_feature (90)..(90): n is a, c, g, or t
  misc_feature (99)..(99): n is a, c, g, or t
  misc_feature (111)..(111): n is a, c, g, or t
  misc_feature (114)..(114): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (210)..(210): n is a, c, g, or t
  misc_feature (216)..(216): n is a, c, g, or t
  misc_feature (219)..(219): n is a, c, g, or t
  misc_feature (222)..(222): n is a, c, g, or t
  misc_feature (231)..(231): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (261)..(261): n is a, c, g, or t
  misc_feature (267)..(267): n is a, c, g, or t
  misc_feature (273)..(273): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (303)..(303): n is a, c, g, or t
  misc_feature (306)..(306): n is a, c, g, or t
  misc_feature (312)..(312): n is a, c, g, or t
  misc_feature (315)..(315): n is a, c, g, or t
  misc_feature (324)..(324): n is a, c, g, or t
  misc_feature (327)..(327): n is a, c, g, or t
  misc_feature (333)..(333): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (363)..(363): n is a, c, g, or t
  misc_feature (369)..(369): n is a, c, g, or t
  misc_feature (375)..(375): n is a, c, g, or t
  misc_feature (381)..(381): n is a, c, g, or t
  misc_feature (384)..(384): n is a, c, g, or t
  misc_feature (390)..(390): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (441)..(441): n is a, c, g, or t
  misc_feature (444)..(444): n is a, c, g, or t
  misc_feature (450)..(450): n is a, c, g, or t
  misc_feature (459)..(459): n is a, c, g, or t
  misc_feature (465)..(465): n is a, c, g, or t
  misc_feature (474)..(474): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (486)..(486): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (501)..(501): n is a, c, g, or t
  misc_feature (504)..(504): n is a, c, g, or t
  misc_feature (507)..(507): n is a, c, g, or t
  misc_feature (513)..(513): n is a, c, g, or t
  misc_feature (519)..(519): n is a, c, g, or t
  misc_feature (522)..(522): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (561)..(561): n is a, c, g, or t
  misc_feature (576)..(576): n is a, c, g, or t
  misc_feature (579)..(579): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (600)..(600): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (696)..(696): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (750)..(750): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (825)..(825): n is a, c, g, or t
  misc_feature (831)..(831): n is a, c, g, or t
  misc_feature (834)..(834): n is a, c, g, or t
  misc_feature (840)..(840): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (858)..(858): n is a, c, g, or t
  misc_feature (867)..(867): n is a, c, g, or t
atgytnathggngcncayggnytngtnttyacnggnacnttygaygaygcnggnytnmgnmgngcnathgarggnacnaarcaygcnggnttygayytnathgarathccnytnatggaygcngcnggnttygaywsngcnytngcngarmgnatgytnmgngayaaygayytngcngtnacngcnwsnytnggnytnacngcngcnacngayytnacnwsngargayccngcngtngtngtngcnggngtnwsnathytngarmgntgyytngaycaygtngcnacnatgggnggngaygtnytntgyggngtnathtaywsngcnatgggnaartayatgacnccngcnacngaraarggnathgcnaaywsncarmgngcnathwsngarytngcngcnaargcngcngarmgnggnathmgnytnwsnytngargtngtnaaymgntaygarwsnaaygtnttyaayacnggnmgnggngcnytnggntayytnggnggngtngarggngaygtnwsngtncayytngayacntaycayatgaayathgargarwsngayttyttycarccngtncaygaygtnwsngargcnggnaarytnggntaygtncayathggngaywsncaymgnggntayytnggnacnggnacngtngayttygcnacnttyttymgngcnytncaygaygtngcntaygayggnccngtngtnttygarwsnttywsnwsngcngtngtnwsngcngarytnwsnaayacnytnggnathtggmgnaayytntggcargaywsngaygayytngcngcncaygcnaaymgnttyytnmgngaygcnytncaygcngtnmgnacnathgayytncay

SEQ ID NO: 78 - protein, 290 aa, Microbacterium profundi
MLIGAHGLVFTGTFDDAGLRRAIEGTKHAGFDLIEIPLMDAAGFDSALAERMLRDNDLAVTASLGLTAATDLTSEDPAVVVAGVSILERCLDHVATMGGDVLCGVIYSAMGKYMTPATEKGIANSQRAISELAAKAAERGIRLSLEVVNRYESNVFNTGRGALGYLGGVEGDVSVHLDTYHMNIEESDFFQPVHDVSEAGKLGYVHIGDSHRGYLGTGTVDFATFFRALHDVAYDGPVVFESFSSAVVSAELSNTLGIWRNLWQDSDDLAAHANRFLRDALHAVRTIDLH

SEQ ID NO: 79 - DNA, 870 bp, Artificial Sequence
  Synthetic
  misc_feature (6)..(6): n is a, c, g, or t
  misc_feature (15)..(15): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (42)..(42): n is a, c, g, or t
  misc_feature (51)..(51): n is a, c, g, or t
  misc_feature (57)..(57): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (180)..(180): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (210)..(210): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (240)..(240): n is a, c, g, or t
  misc_feature (243)..(243): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (270)..(270): n is a, c, g, or t
  misc_feature (273)..(273): n is a, c, g, or t
  misc_feature (276)..(276): n is a, c, g, or t
  misc_feature (282)..(282): n is a, c, g, or t
  misc_feature (285)..(285): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (489)..(489): n is a, c, g, or t
  misc_feature (492)..(492): n is a, c, g, or t
  misc_feature (495)..(495): n is a, c, g, or t
  misc_feature (501)..(501): n is a, c, g, or t
  misc_feature (504)..(504): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (672)..(672): n is a, c, g, or t
  misc_feature (675)..(675): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (693)..(693): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (768)..(768): n is a, c, g, or t
  misc_feature (771)..(771): n is a, c, g, or t
  misc_feature (774)..(774): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (834)..(834): n is a, c, g, or t
  misc_feature (846)..(846): n is a, c, g, or t
  misc_feature (849)..(849): n is a, c, g, or t
  misc_feature (852)..(852): n is a, c, g, or t
  misc_feature (858)..(858): n is a, c, g, or t
  misc_feature (864)..(864): n is a, c, g, or t
  misc_feature (867)..(867): n is a, c, g, or t
atgwsncarathggntgycayggnwsngtntggacnggngtnttygayccngarwsnttymgnmgnwsngtngcngcnacngtngargcnggntaygayytnathgarathccnytnytngayccntaywsnttygaygcnacngcnggnmgnaargcngtngaygartayggnathgcnathaaygcnwsnytnggnytngaygaywsnacngayathwsnwsngaygayccngaygcngtnaargcnggngargcnytnytnaaymgngcngtngaygtnytngaygarytnggnggncartggytngtnggngtngtntayggngcnytnaaraarcayatgmgnccngcnacngcnwsnggnmgnmgnaayggncargargtnytnmgnmgngtnwsngaymgngcncargcngcnggngtnaargtnggnytngargtngtnaaymgntaygaracnaayathytnaayacnwsnaarcargcngtngcntaygtnacngarytngcncayccnaaygtntaygtncayytngayacntaycayatgaayathgargarwsngayatgatgaayccngtnytngaygcnggngaymgnytnggntaygtncayathggngarwsncaymgnggntayytnggnwsnggnwsngtngayttygayacnytnttymgnwsnytnaarmgnathggntaygayggnccnathacnttygarwsnttywsnwsngcngtngtngaygaraarytnwsntayatgytnggngtntggmgnaayytntgggaygaywsnwsngayytngcngcncaygcnaaygayttyathmgnaayaarathmgngcngtngayacnathwsnytncay

SEQ ID NO: 80 - protein, 290 aa, Corynebacterium-like bacterium B27
MSQIGCHGSVWTGVFDPESFRRSVAATVEAGYDLIEIPLLDPYSFDATAGRKAVDEYGIAINASLGLDDSTDISSDDPDAVKAGEALLNRAVDVLDELGGQWLVGVVYGALKKHMRPATASGRRNGQEVLRRVSDRAQAAGVKVGLEVVNRYETNILNTSKQAVAYVTELAHPNVYVHLDTYHMNIEESDMMNPVLDAGDRLGYVHIGESHRGYLGSGSVDFDTLFRSLKRIGYDGPITFESFSSAVVDEKLSYMLGVWRNLWDDSSDLAAHANDFIRNKIRAVDTISLH

SEQ ID NO: 81 - DNA, 864 bp, Artificial Sequence
  Synthetic
  misc_feature (9)..(9): n is a, c, g, or t
  misc_feature (18)..(18): n is a, c, g, or t
  misc_feature (21)..(21): n is a, c, g, or t
  misc_feature (24)..(24): n is a, c, g, or t
  misc_feature (30)..(30): n is a, c, g, or t
  misc_feature (33)..(33): n is a, c, g, or t
  misc_feature (36)..(36): n is a, c, g, or t
  misc_feature (42)..(42): n is a, c, g, or t
  misc_feature (45)..(45): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (72)..(72): n is a, c, g, or t
  misc_feature (75)..(75): n is a, c, g, or t
  misc_feature (84)..(84): n is a, c, g, or t
  misc_feature (87)..(87): n is a, c, g, or t
  misc_feature (99)..(99): n is a, c, g, or t
  misc_feature (108)..(108): n is a, c, g, or t
  misc_feature (111)..(111): n is a, c, g, or t
  misc_feature (114)..(114): n is a, c, g, or t
  misc_feature (120)..(120): n is a, c, g, or t
  misc_feature (126)..(126): n is a, c, g, or t
  misc_feature (135)..(135): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (171)..(171): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (204)..(204): n is a, c, g, or t
  misc_feature (207)..(207): n is a, c, g, or t
  misc_feature (216)..(216): n is a, c, g, or t
  misc_feature (219)..(219): n is a, c, g, or t
  misc_feature (222)..(222): n is a, c, g, or t
  misc_feature (228)..(228): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (270)..(270): n is a, c, g, or t
  misc_feature (276)..(276): n is a, c, g, or t
  misc_feature (279)..(279): n is a, c, g, or t
  misc_feature (288)..(288): n is a, c, g, or t
  misc_feature (294)..(294): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (339)..(339): n is a, c, g, or t
  misc_feature (342)..(342): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (414)..(414): n is a, c, g, or t
  misc_feature (417)..(417): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (438)..(438): n is a, c, g, or t
  misc_feature (441)..(441): n is a, c, g, or t
  misc_feature (447)..(447): n is a, c, g, or t
  misc_feature (456)..(456): n is a, c, g, or t
  misc_feature (462)..(462): n is a, c, g, or t
  misc_feature (471)..(471): n is a, c, g, or t
  misc_feature (474)..(474): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (486)..(486): n is a, c, g, or t
  misc_feature (507)..(507): n is a, c, g, or t
  misc_feature (516)..(516): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (561)..(561): n is a, c, g, or t
  misc_feature (573)..(573): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (600)..(600): n is a, c, g, or t
  misc_feature (603)..(603): n is a, c, g, or t
  misc_feature (609)..(609): n is a, c, g, or t
  misc_feature (618)..(618): n is a, c, g, or t
  misc_feature (624)..(624): n is a, c, g, or t
  misc_feature (630)..(630): n is a, c, g, or t
  misc_feature (633)..(633): n is a, c, g, or t
  misc_feature (639)..(639): n is a, c, g, or t
  misc_feature (642)..(642): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (675)..(675): n is a, c, g, or t
  misc_feature (678)..(678): n is a, c, g, or t
  misc_feature (681)..(681): n is a, c, g, or t
  misc_feature (684)..(684): n is a, c, g, or t
  misc_feature (690)..(690): n is a, c, g, or t
  misc_feature (693)..(693): n is a, c, g, or t
  misc_feature (699)..(699): n is a, c, g, or t
  misc_feature (702)..(702): n is a, c, g, or t
  misc_feature (705)..(705): n is a, c, g, or t
  misc_feature (711)..(711): n is a, c, g, or t
  misc_feature (720)..(720): n is a, c, g, or t
  misc_feature (726)..(726): n is a, c, g, or t
  misc_feature (729)..(729): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (762)..(762): n is a, c, g, or t
  misc_feature (765)..(765): n is a, c, g, or t
  misc_feature (774)..(774): n is a, c, g, or t
  misc_feature (780)..(780): n is a, c, g, or t
  misc_feature (792)..(792): n is a, c, g, or t
  misc_feature (795)..(795): n is a, c, g, or t
  misc_feature (801)..(801): n is a, c, g, or t
  misc_feature (804)..(804): n is a, c, g, or t
  misc_feature (813)..(813): n is a, c, g, or t
  misc_feature (816)..(816): n is a, c, g, or t
  misc_feature (828)..(828): n is a, c, g, or t
  misc_feature (837)..(837): n is a, c, g, or t
  misc_feature (840)..(840): n is a, c, g, or t
  misc_feature (843)..(843): n is a, c, g, or t
  misc_feature (852)..(852): n is a, c, g, or t
  misc_feature (855)..(855): n is a, c, g, or t
  misc_feature (858)..(858): n is a, c, g, or t
atgathggntgycayggnytngtntggwsnggnwsnttyggnmgngarggnatggcnytngcngtngarmgnacncargargcnggnttygayathytngarathccnytnytngayccnttyggnttygaygtngcngcngcnaargargcnytnmgnggnwsnaayytncarytnacngcnwsnatgggnytnccngarggngcngayathwsnacngcngayccngaycargtnmgngcnggngargcngtnytnytnmgngcnytngargtnytncaygarytngarwsncarcayttytgyggngtnytncaygcnatgytnaaraartayccnggnccngcnwsngcngarggnmgnmgnacnwsncargargtnytnmgnmgngtngcngcnmgngcnmgngarytnggnathacnytnwsnytngargtngtnaaymgntaygargcnaayytnttyaayacnggnytnggngcnytngaytayathaargayathggngaygaywsnathaargtncayytngayacntaycayatgaayathgargarwsngayatgatgytnccngtnytngcngcnggngayaarytnggntaygtncayathggngarwsncaymgnggntayytnggnacnggnwsngtngayttygayatgttyttymgngcnytnmgncargtnggnttyacnggnccnathgtnttygarwsnttywsnacngcngtngtngaygaraayytnwsnmgnwsnytngcnathtggmgnaayytntgggaygayggnytngayytnggnaaycaygcnmgngarttyathacnaayaarytnmgngcnaaygaracnytnmgnttycay

SEQ ID NO: 82 - protein, 288 aa, Kineosphaera limosa NBRC 100340
MIGCHGLVWSGSFGREGMALAVERTQEAGFDILEIPLLDPFGFDVAAAKEALRGSNLQLTASMGLPEGADISTADPDQVRAGEAVLLRALEVLHELESQHFCGVLHAMLKKYPGPASAEGRRTSQEVLRRVAARARELGITLSLEVVNRYEANLFNTGLGALDYIKDIGDDSIKVHLDTYHMNIEESDMMLPVLAAGDKLGYVHIGESHRGYLGTGSVDFDMFFRALRQVGFTGPIVFESFSTAVVDENLSRSLAIWRNLWDDGLDLGNHAREFITNKLRANETLRFH

SEQ ID NO: 83 - DNA, 882 bp, Artificial Sequence
  Synthetic
  misc_feature (6)..(6): n is a, c, g, or t
  misc_feature (9)..(9): n is a, c, g, or t
  misc_feature (12)..(12): n is a, c, g, or t
  misc_feature (15)..(15): n is a, c, g, or t
  misc_feature (21)..(21): n is a, c, g, or t
  misc_feature (27)..(27): n is a, c, g, or t
  misc_feature (33)..(33): n is a, c, g, or t
  misc_feature (36)..(36): n is a, c, g, or t
  misc_feature (42)..(42): n is a, c, g, or t
  misc_feature (45)..(45): n is a, c, g, or t
  misc_feature (48)..(48): n is a, c, g, or t
  misc_feature (54)..(54): n is a, c, g, or t
  misc_feature (57)..(57): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (87)..(87): n is a, c, g, or t
  misc_feature (99)..(99): n is a, c, g, or t
  misc_feature (105)..(105): n is a, c, g, or t
  misc_feature (108)..(108): n is a, c, g, or t
  misc_feature (111)..(111): n is a, c, g, or t
  misc_feature (120)..(120): n is a, c, g, or t
  misc_feature (123)..(123): n is a, c, g, or t
  misc_feature (129)..(129): n is a, c, g, or t
  misc_feature (132)..(132): n is a, c, g, or t
  misc_feature (135)..(135): n is a, c, g, or t
  misc_feature (144)..(144): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (171)..(171): n is a, c, g, or t
  misc_feature (174)..(174): n is a, c, g, or t
  misc_feature (180)..(180): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (210)..(210): n is a, c, g, or t
  misc_feature (213)..(213): n is a, c, g, or t
  misc_feature (216)..(216): n is a, c, g, or t
  misc_feature (219)..(219): n is a, c, g, or t
  misc_feature (222)..(222): n is a, c, g, or t
  misc_feature (231)..(231): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (267)..(267): n is a, c, g, or t
  misc_feature (270)..(270): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (330)..(330): n is a, c, g, or t
  misc_feature (333)..(333): n is a, c, g, or t
  misc_feature (336)..(336): n is a, c, g, or t
  misc_feature (339)..(339): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (390)..(390): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (447)..(447): n is a, c, g, or t
  misc_feature (450)..(450): n is a, c, g, or t
  misc_feature (453)..(453): n is a, c, g, or t
  misc_feature (456)..(456): n is a, c, g, or t
  misc_feature (471)..(471): n is a, c, g, or t
  misc_feature (480)..(480): n is a, c, g, or t
  misc_feature (486)..(486): n is a, c, g, or t
  misc_feature (495)..(495): n is a, c, g, or t
  misc_feature (498)..(498): n is a, c, g, or t
  misc_feature (501)..(501): n is a, c, g, or t
  misc_feature (507)..(507): n is a, c, g, or t
  misc_feature (510)..(510): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (531)..(531): n is a, c, g, or t
  misc_feature (543)..(543): n is a, c, g, or t
  misc_feature (546)..(546): n is a, c, g, or t
  misc_feature (555)..(555): n is a, c, g, or t
  misc_feature (561)..(561): n is a, c, g, or t
  misc_feature (591)..(591): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (612)..(612): n is a, c, g, or t
  misc_feature (615)..(615): n is a, c, g, or t
  misc_feature (621)..(621): n is a, c, g, or t
  misc_feature (624)..(624): n is a, c, g, or t
  misc_feature (627)..(627): n is a, c, g, or t
  misc_feature (633)..(633): n is a, c, g, or t
  misc_feature (642)..(642): n is a, c, g, or t
  misc_feature (654)..(654): n is a, c, g, or t
  misc_feature (657)..(657): n is a, c, g, or t
  misc_feature (663)..(663): n is a, c, g, or t
  misc_feature (666)..(666): n is a, c, g, or t
  misc_feature (669)..(669): n is a, c, g, or t
  misc_feature (672)..(672): n is a, c, g, or t
  misc_feature (678)..(678): n is a, c, g, or t
  misc_feature (687)..(687): n is a, c, g, or t
  misc_feature (690)..(690): n is a, c, g, or t
  misc_feature (702)..(702): n is a, c, g, or t
  misc_feature (705)..(705): n is a, c, g, or t
  misc_feature (708)..(708): n is a, c, g, or t
  misc_feature (717)..(717): n is a, c, g, or t
  misc_feature (723)..(723): n is a, c, g, or t
  misc_feature (726)..(726): n is a, c, g, or t
  misc_feature (729)..(729): n is a, c, g, or t
  misc_feature (735)..(735): n is a, c, g, or t
  misc_feature (744)..(744): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (762)..(762): n is a, c, g, or t
  misc_feature (765)..(765): n is a, c, g, or t
  misc_feature (771)..(771): n is a, c, g, or t
  misc_feature (774)..(774): n is a, c, g, or t
  misc_feature (777)..(777): n is a, c, g, or t
  misc_feature (786)..(786): n is a, c, g, or t
  misc_feature (789)..(789): n is a, c, g, or t
  misc_feature (792)..(792): n is a, c, g, or t
  misc_feature (798)..(798): n is a, c, g, or t
  misc_feature (804)..(804): n is a, c, g, or t
  misc_feature (810)..(810): n is a, c, g, or t
  misc_feature (816)..(816): n is a, c, g, or t
  misc_feature (825)..(825): n is a, c, g, or t
  misc_feature (828)..(828): n is a, c, g, or t
  misc_feature (831)..(831): n is a, c, g, or t
  misc_feature (837)..(837): n is a, c, g, or t
  misc_feature (843)..(843): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (870)..(870): n is a, c, g, or t
  misc_feature (873)..(873): n is a, c, g, or t
  misc_feature (876)..(876): n is a, c, g, or t
  misc_feature (879)..(879): n is a, c, g, or t
  misc_feature (882)..(882): n is a, c, g, or t
atgacnacngtnacncargcnaayccnathggngtncaygcnytngtntgggcnggngayacnwsnccncarwsnytnacntaygcnathgayaaracnaargcnacnggnttygayytnytngarytnwsnytncaygaywsngaywsnytngaygtnccngcngcnmgnmgncarytngargaygcnggnytnmgngtngcntgywsnmgnggnytngcnttygaygcngaygtnwsnwsngargayccngcngtngtngarmgnggngarmgnytnytncaywsnwsnytngcngtnacncayggnytnggnggnacncayttyacnggngcnytntaywsngcnytnggnaartaygcnggnccnytnacngcngcnggnmgnmgnaaygcngtnacngtnytnggnmgnytngcncargargcngcnggnytnggnatgacnytnggnytngarathtgyaaymgntaygaracnaaygtnathaayacngcnmgngaygcnytngcnytngcngaygayathggngargayaaygtnytnathcayytngayacntaycayatgaayathgargargaygayytnathmgnccngtncaygargtnggngaymgnytnggntaygtncayathggngaraaycaymgnggntayytnggnwsnggncayytngayttyacngcnttyttycaygcnytngcngayathggntaymgnggnccnathacnttygarwsnttywsnwsngcngtngtngcncarggnytnwsnaaygayytngcngtntggmgngayytntggwsngayggngargayytngcnmgncaygcncayacnttyathacnaaycarytngcngtnwsnggnmgnggnmgn

SEQ ID NO: 84 - protein, 294 aa, Streptomyces bingchenggensis BCW-1
MTTVTQANPIGVHALVWAGDTSPQSLTYAIDKTKATGFDLLELSLHDSDSLDVPAARRQLEDAGLRVACSRGLAFDADVSSEDPAVVERGERLLHSSLAVTHGLGGTHFTGALYSALGKYAGPLTAAGRRNAVTVLGRLAQEAAGLGMTLGLEICNRYETNVINTARDALALADDIGEDNVLIHLDTYHMNIEEDDLIRPVHEVGDRLGYVHIGENHRGYLGSGHLDFTAFFHALADIGYRGPITFESFSSAVVAQGLSNDLAVWRDLWSDGEDLARHAHTFITNQLAVSGRGR

SEQ ID NO: 85 - DNA, 864 bp, Artificial Sequence
  Synthetic
  misc_feature (6)..(6): n is a, c, g, or t
  misc_feature (15)..(15): n is a, c, g, or t
  misc_feature (18)..(18): n is a, c, g, or t
  misc_feature (21)..(21): n is a, c, g, or t
  misc_feature (27)..(27): n is a, c, g, or t
  misc_feature (30)..(30): n is a, c, g, or t
  misc_feature (33)..(33): n is a, c, g, or t
  misc_feature (39)..(39): n is a, c, g, or t
  misc_feature (42)..(42): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (78)..(78): n is a, c, g, or t
  misc_feature (84)..(84): n is a, c, g, or t
  misc_feature (93)..(93): n is a, c, g, or t
  misc_feature (96)..(96): n is a, c, g, or t
  misc_feature (105)..(105): n is a, c, g, or t
  misc_feature (108)..(108): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (129)..(129): n is a, c, g, or t
  misc_feature (132)..(132): n is a, c, g, or t
  misc_feature (138)..(138): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (171)..(171): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (189)..(189): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (213)..(213): n is a, c, g, or t
  misc_feature (216)..(216): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (255)..(255): n is a, c, g, or t
  misc_feature (258)..(258): n is a, c, g, or t
  misc_feature (264)..(264): n is a, c, g, or t
  misc_feature (267)..(267): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (306)..(306): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (324)..(324): n is a, c, g, or t
  misc_feature (330)..(330): n is a, c, g, or t
  misc_feature (333)..(333): n is a, c, g, or t
  misc_feature (336)..(336): n is a, c, g, or t
  misc_feature (339)..(339): n is a, c, g, or t
  misc_feature (348)..(348): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (456)..(456): n is a, c, g, or t
  misc_feature (465)..(465): n is a, c, g, or t
  misc_feature (471)..(471): n is a, c, g, or t
  misc_feature (480)..(480): n is a, c, g, or t
  misc_feature (483)..(483): n is a, c, g, or t
  misc_feature (486)..(486): n is a, c, g, or t
  misc_feature (492)..(492): n is a, c, g, or t
  misc_feature (495)..(495): n is a, c, g, or t
  misc_feature (498)..(498): n is a, c, g, or t
  misc_feature (501)..(501): n is a, c, g, or t
  misc_feature (504)..(504): n is a, c, g, or t
  misc_feature (516)..(516): n is a, c, g, or t
  misc_feature (528)..(528): n is a, c, g, or t
  misc_feature (531)..(531): n is a, c, g, or t
  misc_feature (540)..(540): n is a, c, g, or t
  misc_feature (546)..(546): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (606)..(606): n is a, c, g, or t
  misc_feature (609)..(609): n is a, c, g, or t
  misc_feature (612)..(612): n is a, c, g, or t
  misc_feature (618)..(618): n is a, c, g, or t
  misc_feature (627)..(627): n is a, c, g, or t
  misc_feature (639)..(639): n is a, c, g, or t
  misc_feature (642)..(642): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (663)..(663): n is a, c, g, or t
  misc_feature (672)..(672): n is a, c, g, or t
  misc_feature (675)..(675): n is a, c, g, or t
  misc_feature (687)..(687): n is a, c, g, or t
  misc_feature (690)..(690): n is a, c, g, or t
  misc_feature (693)..(693): n is a, c, g, or t
  misc_feature (702)..(702): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (720)..(720): n is a, c, g, or t
  misc_feature (729)..(729): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (762)..(762): n is a, c, g, or t
  misc_feature (771)..(771): n is a, c, g, or t
  misc_feature (774)..(774): n is a, c, g, or t
  misc_feature (783)..(783): n is a, c, g, or t
  misc_feature (789)..(789): n is a, c, g, or t
  misc_feature (801)..(801): n is a, c, g, or t
  misc_feature (804)..(804): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (816)..(816): n is a, c, g, or t
  misc_feature (822)..(822): n is a, c, g, or t
  misc_feature (834)..(834): n is a, c, g, or t
  misc_feature (837)..(837): n is a, c, g, or t
  misc_feature (840)..(840): n is a, c, g, or t
  misc_feature (852)..(852): n is a, c, g, or t
  misc_feature (855)..(855): n is a, c, g, or t
  misc_feature (858)..(858): n is a, c, g, or t
  misc_feature (861)..(861): n is a, c, g, or t
atgacnaaycarytnggngtncaygcnytngtnttywsnggnggnacnacnccnwsngaratggartayathathggngaracnaaraargcnggnttygayytnytngarytnwsnytncaygaygcngcnaayytngaygtnccngcngcnmgngcngcnytngaygcngcnggnytnggnathgtntgywsnmgnggnytngcnttygcngcngaygtnwsnwsngaygayccngcngtngtngcnaarggngcngarytnytncaytaywsnytnggngtnacncaycarytnggnggnacncayttyacnggngcnytntaywsngcnytnggnaartayggncaygcnytnacnacngcnggnmgngcnaaygtngtngcnacnytnaargayytngcngtngargcngargcnytngayatgacnytnggnytngarathtgyaaymgntaygaracnaaygtnathaayacngcngcngaygcnytnmgnytngcngaygayathggncaygayaaygtnytnathcayytngaywsntaycayatgaayathgargargaygayttygtnmgnccngtncayytngtnggngaymgnytnggntaygtncayathggngaraaycaymgnggntayytnggnwsnggncayytngayttyacnwsnttyttycaygcnytngcngayathwsntayacnggnccnathacnttygarwsnttywsnwsngcngtngtnwsnccnacnytnwsnaaygayytngcnathtggmgnaayytntggaaygayggnccngcnytngcngcncaywsnaaraaytayytnacnacnatgathgarggnacnmgngcncay

SEQ ID NO: 86 - protein, 288 aa, Corynebacterium-like bacterium B27
MTNQLGVHALVFSGGTTPSEMEYIIGETKKAGFDLLELSLHDAANLDVPAARAALDAAGLGIVCSRGLAFAADVSSDDPAVVAKGAELLHYSLGVTHQLGGTHFTGALYSALGKYGHALTTAGRANVVATLKDLAVEAEALDMTLGLEICNRYETNVINTAADALRLADDIGHDNVLIHLDSYHMNIEEDDFVRPVHLVGDRLGYVHIGENHRGYLGSGHLDFTSFFHALADISYTGPITFESFSSAVVSPTLSNDLAIWRNLWNDGPALAAHSKNYLTTMIEGTRAH

SEQ ID NO: 87 - DNA, 879 bp, Artificial Sequence
  Synthetic
  misc_feature (6)..(6): n is a, c, g, or t
  misc_feature (9)..(9): n is a, c, g, or t
  misc_feature (12)..(12): n is a, c, g, or t
  misc_feature (18)..(18): n is a, c, g, or t
  misc_feature (21)..(21): n is a, c, g, or t
  misc_feature (24)..(24): n is a, c, g, or t
  misc_feature (27)..(27): n is a, c, g, or t
  misc_feature (33)..(33): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (84)..(84): n is a, c, g, or t
  misc_feature (90)..(90): n is a, c, g, or t
  misc_feature (96)..(96): n is a, c, g, or t
  misc_feature (99)..(99): n is a, c, g, or t
  misc_feature (102)..(102): n is a, c, g, or t
  misc_feature (111)..(111): n is a, c, g, or t
  misc_feature (114)..(114): n is a, c, g, or t
  misc_feature (120)..(120): n is a, c, g, or t
  misc_feature (123)..(123): n is a, c, g, or t
  misc_feature (126)..(126): n is a, c, g, or t
  misc_feature (135)..(135): n is a, c, g, or t
  misc_feature (138)..(138): n is a, c, g, or t
  misc_feature (144)..(144): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (171)..(171): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (210)..(210): n is a, c, g, or t
  misc_feature (213)..(213): n is a, c, g, or t
  misc_feature (222)..(222): n is a, c, g, or t
  misc_feature (228)..(228): n is a, c, g, or t
  misc_feature (231)..(231): n is a, c, g, or t
  misc_feature (234)..(234): n is a, c, g, or t
  misc_feature (243)..(243): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (270)..(270): n is a, c, g, or t
  misc_feature (273)..(273): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (306)..(306): n is a, c, g, or t
  misc_feature (309)..(309): n is a, c, g, or t
  misc_feature (312)..(312): n is a, c, g, or t
  misc_feature (321)..(321): n is a, c, g, or t
  misc_feature (324)..(324): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (339)..(339): n is a, c, g, or t
  misc_feature (342)..(342): n is a, c, g, or t
  misc_feature (345)..(345): n is a, c, g, or t
  misc_feature (354)..(354): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (381)..(381): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (444)..(444): n is a, c, g, or t
  misc_feature (447)..(447): n is a, c, g, or t
  misc_feature (462)..(462): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (486)..(486): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (501)..(501): n is a, c, g, or t
  misc_feature (504)..(504): n is a, c, g, or t
  misc_feature (507)..(507): n is a, c, g, or t
  misc_feature (510)..(510): n is a, c, g, or t
  misc_feature (522)..(522): n is a, c, g, or t
  misc_feature (534)..(534): n is a, c, g, or t
  misc_feature (546)..(546): n is a, c, g, or t
  misc_feature (552)..(552): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (612)..(612): n is a, c, g, or t
  misc_feature (615)..(615): n is a, c, g, or t
  misc_feature (618)..(618): n is a, c, g, or t
  misc_feature (624)..(624): n is a, c, g, or t
  misc_feature (633)..(633): n is a, c, g, or t
  misc_feature (645)..(645): n is a, c, g, or t
  misc_feature (648)..(648): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (663)..(663): n is a, c, g, or t
  misc_feature (669)..(669): n is a, c, g, or t
  misc_feature (678)..(678): n is a, c, g, or t
  misc_feature (681)..(681): n is a, c, g, or t
  misc_feature (693)..(693): n is a, c, g, or t
  misc_feature (696)..(696): n is a, c, g, or t
  misc_feature (699)..(699): n is a, c, g, or t
  misc_feature (708)..(708): n is a, c, g, or t
  misc_feature (714)..(714): n is a, c, g, or t
  misc_feature (717)..(717): n is a, c, g, or t
  misc_feature (720)..(720): n is a, c, g, or t
  misc_feature (726)..(726): n is a, c, g, or t
  misc_feature (735)..(735): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (765)..(765): n is a, c, g, or t
  misc_feature (768)..(768): n is a, c, g, or t
  misc_feature (777)..(777): n is a, c, g, or t
  misc_feature (780)..(780): n is a, c, g, or t
  misc_feature (783)..(783): n is a, c, g, or t
  misc_feature (789)..(789): n is a, c, g, or t
  misc_feature (795)..(795): n is a, c, g, or t
  misc_feature (807)..(807): n is a, c, g, or t
  misc_feature (816)..(816): n is a, c, g, or t
  misc_feature (819)..(819): n is a, c, g, or t
  misc_feature (822)..(822): n is a, c, g, or t
  misc_feature (828)..(828): n is a, c, g, or t
  misc_feature (831)..(831): n is a, c, g, or t
  misc_feature (834)..(834): n is a, c, g, or t
  misc_feature (843)..(843): n is a, c, g, or t
  misc_feature (852)..(852): n is a, c, g, or t
  misc_feature (855)..(855): n is a, c, g, or t
  misc_feature (858)..(858): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (870)..(870): n is a, c, g, or t
  misc_feature (873)..(873): n is a, c, g, or t
  misc_feature (876)..(876): n is a, c, g, or t
  misc_feature (879)..(879): n is a, c, g, or t
atgacnacnacnaayccnytnggngtncaygcnytngtntgggtnggngayacngcnccngcnwsngtngcnacngcnathwsncaracngargcngcnggntaygayytnytngarytnwsnytncaygayytnggnaayytngayacngcnwsngcnmgnacncarytngargcngcnggnytngcngtngcntgywsnmgnggnytngcnttygaygcngaygtnwsnwsngargayccncargtngtngcnmgnggngcnmgnytnytncargarwsnytngcngcnacnwsngcnytnggnggnmgnathttyacnggngcnytntaywsngcnytnggnaartayccncaygcngtnacnwsngcnggnmgngcnaaygcngtnacngtnathmgngarytngcngtngargcngcnmgncayggngtnacnytnggnytngarathtgyaaymgntaygaracnaaygtngtnaayacngcnmgngaygcnytnmgnytngcngaygayathggngargayaaygtnatgathcayytngayacntaycayatgaayathgargargaygayttygtnmgnccngtnytngaygtngcngaymgnytnggntaygtncayathggngaraaycaymgnggntayytnggnwsnggncayytngayttyacnggnttyttycaygcnytngcngayathggntaygcnggnccnathacnttygarwsnttywsnwsnwsngtngtngcnaarggnytnwsngaygayytngcngtntggmgngayytntgggaygayggnttygayytngcnacncaygcnmgngcnttyatggcnaaycarytngcngcnccnggnggngcnmgngcngcn

SEQ ID NO: 88 - protein, 293 aa, Leifsonia aquatic
MTTTNPLGVHALVWVGDTAPASVATAISQTEAAGYDLLELSLHDLGNLDTASARTQLEAAGLAVACSRGLAFDADVSSEDPQVVARGARLLQESLAATSALGGRIFTGALYSALGKYPHAVTSAGRANAVTVIRELAVEAARHGVTLGLEICNRYETNVVNTARDALRLADDIGEDNVMIHLDTYHMNIEEDDFVRPVLDVADRLGYVHIGENHRGYLGSGHLDFTGFFHALADIGYAGPITFESFSSSVVAKGLSDDLAVWRDLWDDGFDLATHARAFMANQLAAPGGARAA

SEQ ID NO: 89 - DNA, 876 bp, Artificial Sequence
  Synthetic
  misc_feature (6)..(6): n is a, c, g, or t
  misc_feature (9)..(9): n is a, c, g, or t
  misc_feature (15)..(15): n is a, c, g, or t
  misc_feature (18)..(18): n is a, c, g, or t
  misc_feature (21)..(21): n is a, c, g, or t
  misc_feature (30)..(30): n is a, c, g, or t
  misc_feature (33)..(33): n is a, c, g, or t
  misc_feature (36)..(36): n is a, c, g, or t
  misc_feature (42)..(42): n is a, c, g, or t
  misc_feature (45)..(45): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (84)..(84): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (108)..(108): n is a, c, g, or t
  misc_feature (111)..(111): n is a, c, g, or t
  misc_feature (120)..(120): n is a, c, g, or t
  misc_feature (123)..(123): n is a, c, g, or t
  misc_feature (132)..(132): n is a, c, g, or t
  misc_feature (135)..(135): n is a, c, g, or t
  misc_feature (141)..(141): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (174)..(174): n is a, c, g, or t
  misc_feature (180)..(180): n is a, c, g, or t
  misc_feature (183)..(183): n is a, c, g, or t
  misc_feature (189)..(189): n is a, c, g, or t
  misc_feature (192)..(192): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (210)..(210): n is a, c, g, or t
  misc_feature (213)..(213): n is a, c, g, or t
  misc_feature (219)..(219): n is a, c, g, or t
  misc_feature (225)..(225): n is a, c, g, or t
  misc_feature (228)..(228): n is a, c, g, or t
  misc_feature (231)..(231): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (267)..(267): n is a, c, g, or t
  misc_feature (270)..(270): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (303)..(303): n is a, c, g, or t
  misc_feature (306)..(306): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (324)..(324): n is a, c, g, or t
  misc_feature (327)..(327): n is a, c, g, or t
  misc_feature (333)..(333): n is a, c, g, or t
  misc_feature (336)..(336): n is a, c, g, or t
  misc_feature (342)..(342): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (384)..(384): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (405)..(405): n is a, c, g, or t
  misc_feature (408)..(408): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (444)..(444): n is a, c, g, or t
  misc_feature (450)..(450): n is a, c, g, or t
  misc_feature (459)..(459): n is a, c, g, or t
  misc_feature (468)..(468): n is a, c, g, or t
  misc_feature (474)..(474): n is a, c, g, or t
  misc_feature (477)..(477): n is a, c, g, or t
  misc_feature (483)..(483): n is a, c, g, or t
  misc_feature (486)..(486): n is a, c, g, or t
  misc_feature (489)..(489): n is a, c, g, or t
  misc_feature (495)..(495): n is a, c, g, or t
  misc_feature (498)..(498): n is a, c, g, or t
  misc_feature (501)..(501): n is a, c, g, or t
  misc_feature (504)..(504): n is a, c, g, or t
  misc_feature (507)..(507): n is a, c, g, or t
  misc_feature (519)..(519): n is a, c, g, or t
  misc_feature (522)..(522): n is a, c, g, or t
  misc_feature (531)..(531): n is a, c, g, or t
  misc_feature (534)..(534): n is a, c, g, or t
  misc_feature (537)..(537): n is a, c, g, or t
  misc_feature (543)..(543): n is a, c, g, or t
  misc_feature (549)..(549): n is a, c, g, or t
  misc_feature (576)..(576): n is a, c, g, or t
  misc_feature (582)..(582): n is a, c, g, or t
  misc_feature (588)..(588): n is a, c, g, or t
  misc_feature (591)..(591): n is a, c, g, or t
  misc_feature (594)..(594): n is a, c, g, or t
  misc_feature (600)..(600): n is a, c, g, or t
  misc_feature (603)..(603): n is a, c, g, or t
  misc_feature (609)..(609): n is a, c, g, or t
  misc_feature (612)..(612): n is a, c, g, or t
  misc_feature (615)..(615): n is a, c, g, or t
  misc_feature (621)..(621): n is a, c, g, or t
  misc_feature (627)..(627): n is a, c, g, or t
  misc_feature (630)..(630): n is a, c, g, or t
  misc_feature (642)..(642): n is a, c, g, or t
  misc_feature (645)..(645): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (666)..(666): n is a, c, g, or t
  misc_feature (678)..(678): n is a, c, g, or t
  misc_feature (687)..(687): n is a, c, g, or t
  misc_feature (690)..(690): n is a, c, g, or t
  misc_feature (693)..(693): n is a, c, g, or t
  misc_feature (696)..(696): n is a, c, g, or t
  misc_feature (705)..(705): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (720)..(720): n is a, c, g, or t
  misc_feature (723)..(723): n is a, c, g, or t
  misc_feature (732)..(732): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (762)..(762): n is a, c, g, or t
  misc_feature (765)..(765): n is a, c, g, or t
  misc_feature (774)..(774): n is a, c, g, or t
  misc_feature (777)..(777): n is a, c, g, or t
  misc_feature (786)..(786): n is a, c, g, or t
  misc_feature (792)..(792): n is a, c, g, or t
  misc_feature (798)..(798): n is a, c, g, or t
  misc_feature (804)..(804): n is a, c, g, or t
  misc_feature (807)..(807): n is a, c, g, or t
  misc_feature (813)..(813): n is a, c, g, or t
  misc_feature (816)..(816): n is a, c, g, or t
  misc_feature (819)..(819): n is a, c, g, or t
  misc_feature (825)..(825): n is a, c, g, or t
  misc_feature (831)..(831): n is a, c, g, or t
  misc_feature (837)..(837): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (855)..(855): n is a, c, g, or t
  misc_feature (858)..(858): n is a, c, g, or t
  misc_feature (864)..(864): n is a, c, g, or t
  misc_feature (867)..(867): n is a, c, g, or t
  misc_feature (870)..(870): n is a, c, g, or t
  misc_feature (873)..(873): n is a, c, g, or t
  misc_feature (876)..(876): n is a, c, g, or t
atgacngcnaayccnytnggnathcaygcnytngtntgggtnggngayacnwsnccngarwsngtngcngcngcngtngarmgnacngcngcnacnggnttygayytnytngarttywsnytncaygaywsngtnaayytngaymgngcngcnacnmgngcngcnytngargcncayggnytncargcngcntgywsnmgnggnytngcnccngaygcngaygtnwsnwsngargayccngcngtngtnwsnmgnggngcngarytnytncargarwsnytngcngtnacngcngayathggnggnacngtnytnacnggngcnytntaywsngcnttyggnaargcngcngcnccnytnacngcnaarggnmgngcnaaygtngtngcngtnytnaargayytngcngtngaygcngcngcnmgnggngtnacnytnggnytngargtntgyaaymgntaygaracnaaygtngtnaayacngcnmgngaygcngtnmgnytngcngaygayathggngcngayaaygtngtngtncayytngayacntaycayatgaayathgargargaywsnatgwsngayccngtnmgngargtnggngaymgnytnggntaygtncaygtnggngaraaycaymgnggntayytnggnwsnggncayytngayttygarggnttyttyggngcnytngcngayathggntaymgnggnccngtnacnttygarwsnttywsnwsngcngtnytngcnccnggnytnwsnaaygayytngcnathtggmgnaayytntggwsngayggnacngayytngcnmgngargcncayggnttyytnacngcnggnytngaymgngcncaygcngcngtngcnmgn

SEQ ID NO: 90 - protein, 292 aa, Phycicoccus jejuensis
MTANPLGIHALVWVGDTSPESVAAAVERTAATGFDLLEFSLHDSVNLDRAATRAALEAHGLQAACSRGLAPDADVSSEDPAVVSRGAELLQESLAVTADIGGTVLTGALYSAFGKAAAPLTAKGRANVVAVLKDLAVDAAARGVTLGLEVCNRYETNVVNTARDAVRLADDIGADNVVVHLDTYHMNIEEDSMSDPVREVGDRLGYVHVGENHRGYLGSGHLDFEGFFGALADIGYRGPVTFESFSSAVLAPGLSNDLAIWRNLWSDGTDLAREAHGFLTAGLDRAHAAVAR

SEQ ID NO: 91 - DNA, 876 bp, Artificial Sequence; identical to SEQ ID NO: 89
  Synthetic
  misc_feature (6)..(6): n is a, c, g, or t
  misc_feature (9)..(9): n is a, c, g, or t
  misc_feature (15)..(15): n is a, c, g, or t
  misc_feature (18)..(18): n is a, c, g, or t
  misc_feature (21)..(21): n is a, c, g, or t
  misc_feature (30)..(30): n is a, c, g, or t
  misc_feature (33)..(33): n is a, c, g, or t
  misc_feature (36)..(36): n is a, c, g, or t
  misc_feature (42)..(42): n is a, c, g, or t
  misc_feature (45)..(45): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (84)..(84): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (108)..(108): n is a, c, g, or t
  misc_feature (111)..(111): n is a, c, g, or t
  misc_feature (120)..(120): n is a, c, g, or t
  misc_feature (123)..(123): n is a, c, g, or t
  misc_feature (132)..(132): n is a, c, g, or t
  misc_feature (135)..(135): n is a, c, g, or t
  misc_feature (141)..(141): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (174)..(174): n is a, c, g, or t
  misc_feature (180)..(180): n is a, c, g, or t
  misc_feature (183)..(183): n is a, c, g, or t
  misc_feature (189)..(189): n is a, c, g, or t
  misc_feature (192)..(192): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (210)..(210): n is a, c, g, or t
  misc_feature (213)..(213): n is a, c, g, or t
  misc_feature (219)..(219): n is a, c, g, or t
  misc_feature (225)..(225): n is a, c, g, or t
  misc_feature (228)..(228): n is a, c, g, or t
  misc_feature (231)..(231): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (267)..(267): n is a, c, g, or t
  misc_feature (270)..(270): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (303)..(303): n is a, c, g, or t
  misc_feature (306)..(306): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (324)..(324): n is a, c, g, or t
  misc_feature (327)..(327): n is a, c, g, or t
  misc_feature (333)..(333): n is a, c, g, or t
  misc_feature (336)..(336): n is a, c, g, or t
  misc_feature (342)..(342): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (384)..(384): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (405)..(405): n is a, c, g, or t
  misc_feature (408)..(408): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (444)..(444): n is a, c, g, or t
  misc_feature (450)..(450): n is a, c, g, or t
  misc_feature (459)..(459): n is a, c, g, or t
  misc_feature (468)..(468): n is a, c, g, or t
  misc_feature (474)..(474): n is a, c, g, or t
  misc_feature (477)..(477): n is a, c, g, or t
  misc_feature (483)..(483): n is a, c, g, or t
  misc_feature (486)..(486): n is a, c, g, or t
  misc_feature (489)..(489): n is a, c, g, or t
  misc_feature (495)..(495): n is a, c, g, or t
  misc_feature (498)..(498): n is a, c, g, or t
  misc_feature (501)..(501): n is a, c, g, or t
  misc_feature (504)..(504): n is a, c, g, or t
  misc_feature (507)..(507): n is a, c, g, or t
  misc_feature (519)..(519): n is a, c, g, or t
  misc_feature (522)..(522): n is a, c, g, or t
  misc_feature (531)..(531): n is a, c, g, or t
  misc_feature (534)..(534): n is a, c, g, or t
  misc_feature (537)..(537): n is a, c, g, or t
  misc_feature (543)..(543): n is a, c, g, or t
  misc_feature (549)..(549): n is a, c, g, or t
  misc_feature (576)..(576): n is a, c, g, or t
  misc_feature (582)..(582): n is a, c, g, or t
  misc_feature (588)..(588): n is a, c, g, or t
  misc_feature (591)..(591): n is a, c, g, or t
  misc_feature (594)..(594): n is a, c, g, or t
  misc_feature (600)..(600): n is a, c, g, or t
  misc_feature (603)..(603): n is a, c, g, or t
  misc_feature (609)..(609): n is a, c, g, or t
  misc_feature (612)..(612): n is a, c, g, or t
  misc_feature (615)..(615): n is a, c, g, or t
  misc_feature (621)..(621): n is a, c, g, or t
  misc_feature (627)..(627): n is a, c, g, or t
  misc_feature (630)..(630): n is a, c, g, or t
  misc_feature (642)..(642): n is a, c, g, or t
  misc_feature (645)..(645): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (666)..(666): n is a, c, g, or t
  misc_feature (678)..(678): n is a, c, g, or t
  misc_feature (687)..(687): n is a, c, g, or t
  misc_feature (690)..(690): n is a, c, g, or t
  misc_feature (693)..(693): n is a, c, g, or t
  misc_feature (696)..(696): n is a, c, g, or t
  misc_feature (705)..(705): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (720)..(720): n is a, c, g, or t
  misc_feature (723)..(723): n is a, c, g, or t
  misc_feature (732)..(732): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (762)..(762): n is a, c, g, or t
  misc_feature (765)..(765): n is a, c, g, or t
  misc_feature (774)..(774): n is a, c, g, or t
  misc_feature (777)..(777): n is a, c, g, or t
  misc_feature (786)..(786): n is a, c, g, or t
  misc_feature (792)..(792): n is a, c, g, or t
  misc_feature (798)..(798): n is a, c, g, or t
  misc_feature (804)..(804): n is a, c, g, or t
  misc_feature (807)..(807): n is a, c, g, or t
  misc_feature (813)..(813): n is a, c, g, or t
  misc_feature (816)..(816): n is a, c, g, or t
  misc_feature (819)..(819): n is a, c, g, or t
  misc_feature (825)..(825): n is a, c, g, or t
  misc_feature (831)..(831): n is a, c, g, or t
  misc_feature (837)..(837): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (855)..(855): n is a, c, g, or t
  misc_feature (858)..(858): n is a, c, g, or t
  misc_feature (864)..(864): n is a, c, g, or t
  misc_feature (867)..(867): n is a, c, g, or t
  misc_feature (870)..(870): n is a, c, g, or t
  misc_feature (873)..(873): n is a, c, g, or t
  misc_feature (876)..(876): n is a, c, g, or t

SEQ ID NO: 92 - protein, 295 aa, Tetrasphaera japonica T1-X7
MTPPPTSPLGIHALVWVGDTSPDSVRYAVERTAACGYDLLELSLHDSVNLDREATRKLLQENGLRAACSRGLARDADVSSDDPEVVARGAELLHESLAVTAAIGGTVLTGALYSAFGKAPAPLTAKGRANVVSVLRELAEEAASHEVTLGLEICNRYETNVVNTARDCLVLADDIGADNVMVHLDTYHMNVEEADLVTPVRDLGERLGYVHIGENHRGYLGSGHIDFPAFFGALVEIGYAGPITFESFSSAVVAPGLSNDLAIWRNLWDDGEDLARAAHAFVSDGLRSAWASSAA

SEQ ID NO: 93 - DNA, 870 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (48)..(48): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (114)..(114): n is a, c, g, or t
  misc_feature (117)..(117): n is a, c, g, or t
  misc_feature (126)..(126): n is a, c, g, or t
  misc_feature (132)..(132): n is a, c, g, or t
  misc_feature (135)..(135): n is a, c, g, or t
  misc_feature (141)..(141): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (285)..(285): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (336)..(336): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (378)..(378): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (405)..(405): n is a, c, g, or t
  misc_feature (411)..(411): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (492)..(492): n is a, c, g, or t
  misc_feature (498)..(498): n is a, c, g, or t
  misc_feature (513)..(513): n is a, c, g, or t
  misc_feature (516)..(516): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (672)..(672): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (768)..(768): n is a, c, g, or t
  misc_feature (771)..(771): n is a, c, g, or t
  misc_feature (774)..(774): n is a, c, g, or t
  misc_feature (780)..(780): n is a, c, g, or t
  misc_feature (786)..(786): n is a, c, g, or t
  misc_feature (792)..(792): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (834)..(834): n is a, c, g, or t
  misc_feature (837)..(837): n is a, c, g, or t
  misc_feature (849)..(849): n is a, c, g, or t
  misc_feature (852)..(852): n is a, c, g, or t
  misc_feature (858)..(858): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (870)..(870): n is a, c, g, or t
atgaaygayytnggngtncaygcnytngtntggacnggngaytggacnccngarggngcnmgnacngcngcngcnmgnwsnmgngargcnggntaygayytngtngarathwsnytncaygayccngarytngtngaygtnaargayacnmgncargtnytngcngaycayggnytnmgngtngcntgywsnmgnggnytnwsnttygaywsngaygtnwsnwsngaygayccngayacngcngcnmgnggngargcnytnytnmgncargcnytnmgnathacncaygayytnggnggngaytayttyggnggngtnytntaywsngcnytnggnaartayggnmgnccngcnacngcnmgnggnmgngarcaygcngtnmgngcnytnmgnmgnytngcngcngargcngayggnytnggngtnacnytnggnytngargtngtnaaymgntaygaracnaaygtngtnaayacngcnmgncartgyytngayytnathgaygarathggngcngayaaygtnytngtncayytngayacntaycayatgaayathgargarcargayttywsnmgnccngtnmgngcntgyggngaymgnytnggntaygtncayathggngarwsncaymgnggntayytnggnwsnggnacnathgayttyccngcnttyttycaygcnytngcngayathggntaycarggnccnathacnttygarwsnttywsnwsngcngtngtngcnccnggnytnwsncaygayytngcngtntggmgnaayytntggwsngarggnccngayytngcngcncaygcnmgnwsntayatggcngcncarathaargcngcncaygcnmgnacngcngcn

SEQ ID NO: 94 - protein, 290 aa, Streptomyces himastatinicus ATCC 53653
MNDLGVHALVWTGDWTPEGARTAAARSREAGYDLVEISLHDPELVDVKDTRQVLADHGLRVACSRGLSFDSDVSSDDPDTAARGEALLRQALRITHDLGGDYFGGVLYSALGKYGRPATARGREHAVRALRRLAAEADGLGVTLGLEVVNRYETNVVNTARQCLDLIDEIGADNVLVHLDTYHMNIEEQDFSRPVRACGDRLGYVHIGESHRGYLGSGTIDFPAFFHALADIGYQGPITFESFSSAVVAPGLSHDLAVWRNLWSEGPDLAAHARSYMAAQIKAAHARTAA

SEQ ID NO: 95 - DNA, 867 bp, Artificial Sequence
  Synthetic
  misc_feature (9)..(9): n is a, c, g, or t
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (72)..(72): n is a, c, g, or t
  misc_feature (75)..(75): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (126)..(126): n is a, c, g, or t
  misc_feature (129)..(129): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (297)..(297): n is a, c, g, or t
  misc_feature (300)..(300): n is a, c, g, or t
  misc_feature (309)..(309): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (387)..(387): n is a, c, g, or t
  misc_feature (390)..(390): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (489)..(489): n is a, c, g, or t
  misc_feature (492)..(492): n is a, c, g, or t
  misc_feature (501)..(501): n is a, c, g, or t
  misc_feature (510)..(510): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (567)..(567): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (792)..(792): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (837)..(837): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (864)..(864): n is a, c, g, or t
  misc_feature (867)..(867): n is a, c, g, or t
atgaayccngtnggngtncaygcnytngtntgggcnggngayytnacnccnaarwsngtngcnmgnathgtnacngarwsnaarmgngcnggntaygayttyathgarytnwsnytncaygayytnacngayttygaycargayggnytnmgngarytnytngtngcngaraaratgggngtnwsntgywsnmgnggnytngcnttygaygcngaygtnwsnwsngargayccngtngtngtngcnmgnggngtncarytnytngargarwsnytncargtngcnwsnmgnathggngcnaartayytntgyggnggnytntaywsngcnttyggnaartaycarcarccngtnwsngcncarggnmgnmgnaaygtngtngaywsnytnaarmgngtngcngaymgngcngcncartaygayathacnytnggnytngarathgtnaaymgntaygarwsnaaygtngtnaayacnacngarcargcnytngarathytngarcargtnggnwsnccncarytnaargtncayytngayathtaycayatgaayathgargargcngayttytaywsnccngtnytngcntgyggngayaarytnggntaygtncayathggngaraaycaymgnggntayytnggnwsnggncayytngayttyccnwsnttyttycaygcnytngcncayathaaytaycarggnccnathgcnttygarwsnttywsnwsngcngtngtnwsnmgnggnytnwsngtngayytnwsnathtggmgnaayytntggwsngayggnttygayytngcnwsncaygcnmgnmgnttyathgayggncayytncargcnwsnmgnaarcarggngcn

SEQ ID NO: 96 - protein, 289 aa, Pantoea sp. A4
MNPVGVHALVWAGDLTPKSVARIVTESKRAGYDFIELSLHDLTDFDQDGLRELLVAEKMGVSCSRGLAFDADVSSEDPVVVARGVQLLEESLQVASRIGAKYLCGGLYSAFGKYQQPVSAQGRRNVVDSLKRVADRAAQYDITLGLEIVNRYESNVVNTTEQALEILEQVGSPQLKVHLDIYHMNIEEADFYSPVLACGDKLGYVHIGENHRGYLGSGHLDFPSFFHALAHINYQGPIAFESFSSAVVSRGLSVDLSIWRNLWSDGFDLASHARRFIDGHLQASRKQGA

SEQ ID NO: 97 - DNA, 870 bp, Artificial Sequence
  Synthetic
  misc_feature (9)..(9): n is a, c, g, or t
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (72)..(72): n is a, c, g, or t
  misc_feature (78)..(78): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (99)..(99): n is a, c, g, or t
  misc_feature (102)..(102): n is a, c, g, or t
  misc_feature (105)..(105): n is a, c, g, or t
  misc_feature (114)..(114): n is a, c, g, or t
  misc_feature (117)..(117): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (135)..(135): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (168)..(168): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (270)..(270): n is a, c, g, or t
  misc_feature (273)..(273): n is a, c, g, or t
  misc_feature (276)..(276): n is a, c, g, or t
  misc_feature (285)..(285): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (390)..(390): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (411)..(411): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (504)..(504): n is a, c, g, or t
  misc_feature (510)..(510): n is a, c, g, or t
  misc_feature (513)..(513): n is a, c, g, or t
  misc_feature (516)..(516): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (567)..(567): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (591)..(591): n is a, c, g, or t
  misc_feature (597)..(597): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (693)..(693): n is a, c, g, or t
  misc_feature (699)..(699): n is a, c, g, or t
  misc_feature (705)..(705): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (762)..(762): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (804)..(804): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (834)..(834): n is a, c, g, or t
  misc_feature (837)..(837): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (858)..(858): n is a, c, g, or t
  misc_feature (861)..(861): n is a, c, g, or t
  misc_feature (867)..(867): n is a, c, g, or t
  misc_feature (870)..(870): n is a, c, g, or t
atgaayacnytnggngtncaygcnytngtntgggcnggngayytnacngcnccnwsngtngaraarathgtnaarggnwsnaargcngcnggntayggnytngtngarttywsnytncaygayacnwsngtnytngaygtngcngcnacnmgngcnytnatggarmgngartgyathgargtngcntgywsnmgnggnytngcnttygaygcngaygtnwsnwsngaygaycaygargtngtngcnmgnggngtngcnytnytngarwsnwsnytngayathgcncaywsnytnggnwsnaartayttytgyggnggnytntaywsngcnttyggnaartayacnmgnccngtnwsngcncarggnmgnmgnaaygtngtnwsnwsnytnaarmgngtngcngayaargcngcnggnytnggnathacnytnggnytngargtngtnaaymgntaygarwsnaaygtngtnaayacnacngarcargcnytngargtnathgcncargtnggngcngayaayytnaargtncayytngayathtaycayatgaayathgargargcngayttyttywsnccngtnathgcntgyggngayaarytnggntaygtncayathggngaraaycaymgnggnttyytnggnwsnggncayytngayttygcnacnttyttycaygcnytngcnacnathggntaymgnggnccnathacnttygarwsnttywsnwsngcngtngtnwsnaarggnytnwsngtngayytngcnathtggmgnaayytntgggaygaywsngcnacnytngcnacncaygcnmgngayttyatggcnytncaygcnwsngcngcnggnytnggnaargcngcn

SEQ ID NO: 98 - protein, 290 aa, Burkholderia andropogonis
MNTLGVHALVWAGDLTAPSVEKIVKGSKAAGYGLVEFSLHDTSVLDVAATRALMERECIEVACSRGLAFDADVSSDDHEVVARGVALLESSLDIAHSLGSKYFCGGLYSAFGKYTRPVSAQGRRNVVSSLKRVADKAAGLGITLGLEVVNRYESNVVNTTEQALEVIAQVGADNLKVHLDIYHMNIEEADFFSPVIACGDKLGYVHIGENHRGFLGSGHLDFATFFHALATIGYRGPITFESFSSAVVSKGLSVDLAIWRNLWDDSATLATHARDFMALHASAAGLGKAA

SEQ ID NO: 99 - DNA, 876 bp, Artificial Sequence
  Synthetic
  misc_feature (12)..(12): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (33)..(33): n is a, c, g, or t
  misc_feature (39)..(39): n is a, c, g, or t
  misc_feature (42)..(42): n is a, c, g, or t
  misc_feature (45)..(45): n is a, c, g, or t
  misc_feature (51)..(51): n is a, c, g, or t
  misc_feature (54)..(54): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (84)..(84): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (102)..(102): n is a, c, g, or t
  misc_feature (108)..(108): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (189)..(189): n is a, c, g, or t
  misc_feature (192)..(192): n is a, c, g, or t
  misc_feature (201)..(201): n is a, c, g, or t
  misc_feature (207)..(207): n is a, c, g, or t
  misc_feature (210)..(210): n is a, c, g, or t
  misc_feature (213)..(213): n is a, c, g, or t
  misc_feature (216)..(216): n is a, c, g, or t
  misc_feature (219)..(219): n is a, c, g, or t
  misc_feature (228)..(228): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (249)..(249): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (324)..(324): n is a, c, g, or t
  misc_feature (330)..(330): n is a, c, g, or t
  misc_feature (333)..(333): n is a, c, g, or t
  misc_feature (336)..(336): n is a, c, g, or t
  misc_feature (342)..(342): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (450)..(450): n is a, c, g, or t
  misc_feature (453)..(453): n is a, c, g, or t
  misc_feature (459)..(459): n is a, c, g, or t
  misc_feature (462)..(462): n is a, c, g, or t
  misc_feature (468)..(468): n is a, c, g, or t
  misc_feature (477)..(477): n is a, c, g, or t
  misc_feature (483)..(483): n is a, c, g, or t
  misc_feature (486)..(486): n is a, c, g, or t
  misc_feature (492)..(492): n is a, c, g, or t
  misc_feature (495)..(495): n is a, c, g, or t
  misc_feature (504)..(504): n is a, c, g, or t
  misc_feature (507)..(507): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (534)..(534): n is a, c, g, or t
  misc_feature (540)..(540): n is a, c, g, or t
  misc_feature (546)..(546): n is a, c, g, or t
  misc_feature (552)..(552): n is a, c, g, or t
  misc_feature (558)..(558): n is a, c, g, or t
  misc_feature (582)..(582): n is a, c, g, or t
  misc_feature (588)..(588): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (612)..(612): n is a, c, g, or t
  misc_feature (618)..(618): n is a, c, g, or t
  misc_feature (621)..(621): n is a, c, g, or t
  misc_feature (624)..(624): n is a, c, g, or t
  misc_feature (630)..(630): n is a, c, g, or t
  misc_feature (639)..(639): n is a, c, g, or t
  misc_feature (651)..(651): n is a, c, g, or t
  misc_feature (654)..(654): n is a, c, g, or t
  misc_feature (660)..(660): n is a, c, g, or t
  misc_feature (663)..(663): n is a, c, g, or t
  misc_feature (666)..(666): n is a, c, g, or t
  misc_feature (669)..(669): n is a, c, g, or t
  misc_feature (675)..(675): n is a, c, g, or t
  misc_feature (684)..(684): n is a, c, g, or t
  misc_feature (687)..(687): n is a, c, g, or t
  misc_feature (699)..(699): n is a, c, g, or t
  misc_feature (702)..(702): n is a, c, g, or t
  misc_feature (705)..(705): n is a, c, g, or t
  misc_feature (714)..(714): n is a, c, g, or t
  misc_feature (720)..(720): n is a, c, g, or t
  misc_feature (723)..(723): n is a, c, g, or t
  misc_feature (726)..(726): n is a, c, g, or t
  misc_feature (729)..(729): n is a, c, g, or t
  misc_feature (732)..(732): n is a, c, g, or t
  misc_feature (741)..(741): n is a, c, g, or t
  misc_feature (747)..(747): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (762)..(762): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (774)..(774): n is a, c, g, or t
  misc_feature (777)..(777): n is a, c, g, or t
  misc_feature (783)..(783): n is a, c, g, or t
  misc_feature (786)..(786): n is a, c, g, or t
  misc_feature (795)..(795): n is a, c, g, or t
  misc_feature (801)..(801): n is a, c, g, or t
  misc_feature (807)..(807): n is a, c, g, or t
  misc_feature (813)..(813): n is a, c, g, or t
  misc_feature (816)..(816): n is a, c, g, or t
  misc_feature (822)..(822): n is a, c, g, or t
  misc_feature (825)..(825): n is a, c, g, or t
  misc_feature (828)..(828): n is a, c, g, or t
  misc_feature (834)..(834): n is a, c, g, or t
  misc_feature (840)..(840): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (858)..(858): n is a, c, g, or t
  misc_feature (864)..(864): n is a, c, g, or t
  misc_feature (867)..(867): n is a, c, g, or t
  misc_feature (873)..(873): n is a, c, g, or t
  misc_feature (876)..(876): n is a, c, g, or t
atggaycaygtnttyccnaayccnytnggngtncaywsnytngtntggacnggngartggacngcnggngcngcnmgngaygcngtnmgngcnacngcngcntgyggntaygayytnytngarytnacnytncaygayacnacngcnathgayacngcnggnacnmgnaayytnytngcngarcayggngtngarathgcntgywsnmgnggnytnwsnttygargcngayytnwsnwsnacngaygcngargtnwsngcnmgnggngargcnytnytngaygarwsnytnmgngtngcnggngarytnggngcnmgntayytntgyggngcnytntayggngcnytnggnaartayccnggnccngcnwsngcnmgnggnmgngcncaygtngtngcnggnytnacnmgnytngcnggnmgngcngcngayytnggnathacnytnggnytngargtngtnaaymgntaygarwsnaayytngtnaayacngcngarcargcnytngcnytnathgcngargtngaygcnccnaayytnatgytncayytngayacntaycayatgaayathgargarccngayytngtnacnccngtnytnmgngcnggngarmgnytnggntaygtncayathggngaraaycaymgnggntayytnggnwsnggncayytngayttyggngcnttyttycaygcnytngcngarathggntaygcnggnccngtnacnttygarwsnttywsnwsngcngtngtnwsnccnggnytnacngcngayytngcnathtggmgngayytntggacngayggngcngayytngcngcncaygcncarmgnttyathgcnggnggnytngargcngcntggmgnmgn

SEQ ID NO: 100 - protein, 292 aa, Sciscionella sp. SE31
MDHVFPNPLGVHSLVWTGEWTAGAARDAVRATAACGYDLLELTLHDTTAIDTAGTRNLLAEHGVEIACSRGLSFEADLSSTDAEVSARGEALLDESLRVAGELGARYLCGALYGALGKYPGPASARGRAHVVAGLTRLAGRAADLGITLGLEVVNRYESNLVNTAEQALALIAEVDAPNLMLHLDTYHMNIEEPDLVTPVLRAGERLGYVHIGENHRGYLGSGHLDFGAFFHALAEIGYAGPVTFESFSSAVVSPGLTADLAIWRDLWTDGADLAAHAQRFIAGGLEAAWRR

SEQ ID NO: 101 - DNA, 876 bp, Artificial Sequence
  Synthetic
  misc_feature (12)..(12): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (33)..(33): n is a, c, g, or t
  misc_feature (39)..(39): n is a, c, g, or t
  misc_feature (42)..(42): n is a, c, g, or t
  misc_feature (45)..(45): n is a, c, g, or t
  misc_feature (51)..(51): n is a, c, g, or t
  misc_feature (54)..(54): n is a, c, g, or t
  misc_feature (63)..(63): n is a, c, g, or t
  misc_feature (66)..(66): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (84)..(84): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (102)..(102): n is a, c, g, or t
  misc_feature (108)..(108): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (171)..(171): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (201)..(201): n is a, c, g, or t
  misc_feature (207)..(207): n is a, c, g, or t
  misc_feature (210)..(210): n is a, c, g, or t
  misc_feature (213)..(213): n is a, c, g, or t
  misc_feature (216)..(216): n is a, c, g, or t
  misc_feature (219)..(219): n is a, c, g, or t
  misc_feature (228)..(228): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (249)..(249): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (324)..(324): n is a, c, g, or t
  misc_feature (330)..(330): n is a, c, g, or t
  misc_feature (333)..(333): n is a, c, g, or t
  misc_feature (336)..(336): n is a, c, g, or t
  misc_feature (342)..(342): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (450)..(450): n is a, c, g, or t
  misc_feature (453)..(453): n is a, c, g, or t
  misc_feature (459)..(459): n is a, c, g, or t
  misc_feature (462)..(462): n is a, c, g, or t
  misc_feature (468)..(468): n is a, c, g, or t
  misc_feature (477)..(477): n is a, c, g, or t
  misc_feature (483)..(483): n is a, c, g, or t
  misc_feature (486)..(486): n is a, c, g, or t
  misc_feature (492)..(492): n is a, c, g, or t
  misc_feature (495)..(495): n is a, c, g, or t
  misc_feature (504)..(504): n is a, c, g, or t
  misc_feature (507)..(507): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (534)..(534): n is a, c, g, or t
  misc_feature (540)..(540): n is a, c, g, or t
  misc_feature (543)..(543): n is a, c, g, or t
  misc_feature (546)..(546): n is a, c, g, or t
  misc_feature (552)..(552): n is a, c, g, or t
  misc_feature (558)..(558): n is a, c, g, or t
  misc_feature (582)..(582): n is a, c, g, or t
  misc_feature (588)..(588): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (612)..(612): n is a, c, g, or t
  misc_feature (618)..(618): n is a, c, g, or t
  misc_feature (621)..(621): n is a, c, g, or t
  misc_feature (624)..(624): n is a, c, g, or t
  misc_feature (630)..(630): n is a, c, g, or t
  misc_feature (639)..(639): n is a, c, g, or t
  misc_feature (651)..(651): n is a, c, g, or t
  misc_feature (654)..(654): n is a, c, g, or t
  misc_feature (660)..(660): n is a, c, g, or t
  misc_feature (663)..(663): n is a, c, g, or t
  misc_feature (666)..(666): n is a, c, g, or t
  misc_feature (669)..(669): n is a, c, g, or t
  misc_feature (675)..(675): n is a, c, g, or t
  misc_feature (684)..(684): n is a, c, g, or t
  misc_feature (687)..(687): n is a, c, g, or t
  misc_feature (699)..(699): n is a, c, g, or t
  misc_feature (702)..(702): n is a, c, g, or t
  misc_feature (705)..(705): n is a, c, g, or t
  misc_feature (714)..(714): n is a, c, g, or t
  misc_feature (720)..(720): n is a, c, g, or t
  misc_feature (723)..(723): n is a, c, g, or t
  misc_feature (726)..(726): n is a, c, g, or t
  misc_feature (729)..(729): n is a, c, g, or t
  misc_feature (732)..(732): n is a, c, g, or t
  misc_feature (741)..(741): n is a, c, g, or t
  misc_feature (747)..(747): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (762)..(762): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (774)..(774): n is a, c, g, or t
  misc_feature (777)..(777): n is a, c, g, or t
  misc_feature (783)..(783): n is a, c, g, or t
  misc_feature (786)..(786): n is a, c, g, or t
  misc_feature (795)..(795): n is a, c, g, or t
  misc_feature (801)..(801): n is a, c, g, or t
  misc_feature (807)..(807): n is a, c, g, or t
  misc_feature (813)..(813): n is a, c, g, or t
  misc_feature (816)..(816): n is a, c, g, or t
  misc_feature (822)..(822): n is a, c, g, or t
  misc_feature (825)..(825): n is a, c, g, or t
  misc_feature (828)..(828): n is a, c, g, or t
  misc_feature (834)..(834): n is a, c, g, or t
  misc_feature (840)..(840): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (858)..(858): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (876)..(876): n is a, c, g, or t
atggaycaygtnttyccnaayccnytnggngtncaywsnytngtntggacnggngartggacnccngargcngcnmgngaygcngtnmgnacnacngcngcntgyggntaygayytnytngarytnacnytncaygayacnacngcnathgayacngcnggnacnmgnmgnytnytngcngartayggngtnggnathgcntgywsnmgnggnytnwsnttygargcngayytnwsnwsngcngayccngargtnwsngcnmgnggngargcnytnytnggngarwsnytnmgngtngcnggngarytnggnacnwsntayytntgyggngcnytntayggngcnytnggnaartayccnggnccngcnwsngcnmgnggnmgngcncaygtngtngcnggnytnacnmgnytngcngcnmgngcngcngayytnggnathacnytnggnytngargtngtnaaymgntaygarwsnaayytngtnaayacngcngarcargcnytngtnytnathgcngargtnggngcnccnaayytngtnytncayytngayacntaycayatgaayathgargarccngayytngtnacnccngtnytnmgngcnggngarmgnytnggntaygtncayathggngaraaycaymgnggntayytnggnwsnggncayytngayttyggnacnttyttycaygcnytngcngarathggntayacnggnccngtnacnttygarwsnttywsnwsngcngtngtnwsnccnggnytnacngcngayytngcnathtggmgngayytntggacngayggngcngayytngcngcncaygcncarmgnttyathgcnggnggnytnacngcngcntggtgymgn

SEQ ID NO: 102 - protein, 292 aa, Sciscionella marina
MDHVFPNPLGVHSLVWTGEWTPEAARDAVRTTAACGYDLLELTLHDTTAIDTAGTRRLLAEYGVGIACSRGLSFEADLSSADPEVSARGEALLGESLRVAGELGTSYLCGALYGALGKYPGPASARGRAHVVAGLTRLAARAADLGITLGLEVVNRYESNLVNTAEQALVLIAEVGAPNLVLHLDTYHMNIEEPDLVTPVLRAGERLGYVHIGENHRGYLGSGHLDFGTFFHALAEIGYTGPVTFESFSSAVVSPGLTADLAIWRDLWTDGADLAAHAQRFIAGGLTAAWCR

SEQ ID NO: 103 - DNA, 885 bp, Artificial Sequence
  Synthetic
  misc_feature (9)..(9): n is a, c, g, or t
  misc_feature (12)..(12): n is a, c, g, or t
  misc_feature (15)..(15): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (78)..(78): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (156)..(156): n is a, c, g, or t
  misc_feature (159)..(159): n is a, c, g, or t
  misc_feature (183)..(183): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (210)..(210): n is a, c, g, or t
  misc_feature (219)..(219): n is a, c, g, or t
  misc_feature (222)..(222): n is a, c, g, or t
  misc_feature (231)..(231): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (255)..(255): n is a, c, g, or t
  misc_feature (261)..(261): n is a, c, g, or t
  misc_feature (270)..(270): n is a, c, g, or t
  misc_feature (276)..(276): n is a, c, g, or t
  misc_feature (282)..(282): n is a, c, g, or t
  misc_feature (285)..(285): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (324)..(324): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (342)..(342): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (363)..(363): n is a, c, g, or t
  misc_feature (366)..(366): n is a, c, g, or t
  misc_feature (375)..(375): n is a, c, g, or t
  misc_feature (384)..(384): n is a, c, g, or t
  misc_feature (393)..(393): n is a, c, g, or t
  misc_feature (399)..(399): n is a, c, g, or t
  misc_feature (405)..(405): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (441)..(441): n is a, c, g, or t
  misc_feature (444)..(444): n is a, c, g, or t
  misc_feature (450)..(450): n is a, c, g, or t
  misc_feature (459)..(459): n is a, c, g, or t
  misc_feature (468)..(468): n is a, c, g, or t
  misc_feature (474)..(474): n is a, c, g, or t
  misc_feature (477)..(477): n is a, c, g, or t
  misc_feature (480)..(480): n is a, c, g, or t
  misc_feature (486)..(486): n is a, c, g, or t
  misc_feature (489)..(489): n is a, c, g, or t
  misc_feature (498)..(498): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (522)..(522): n is a, c, g, or t
  misc_feature (528)..(528): n is a, c, g, or t
  misc_feature (534)..(534): n is a, c, g, or t
  misc_feature (540)..(540): n is a, c, g, or t
  misc_feature (564)..(564): n is a, c, g, or t
  misc_feature (573)..(573): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (612)..(612): n is a, c, g, or t
  misc_feature (621)..(621): n is a, c, g, or t
  misc_feature (627)..(627): n is a, c, g, or t
  misc_feature (633)..(633): n is a, c, g, or t
  misc_feature (636)..(636): n is a, c, g, or t
  misc_feature (642)..(642): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (666)..(666): n is a, c, g, or t
  misc_feature (678)..(678): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (705)..(705): n is a, c, g, or t
  misc_feature (708)..(708): n is a, c, g, or t
  misc_feature (714)..(714): n is a, c, g, or t
  misc_feature (723)..(723): n is a, c, g, or t
  misc_feature (729)..(729): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (753)..(753): n is a, c, g, or t
  misc_feature (756)..(756): n is a, c, g, or t
  misc_feature (762)..(762): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (777)..(777): n is a, c, g, or t
  misc_feature (783)..(783): n is a, c, g, or t
  misc_feature (789)..(789): n is a, c, g, or t
  misc_feature (795)..(795): n is a, c, g, or t
  misc_feature (804)..(804): n is a, c, g, or t
  misc_feature (807)..(807): n is a, c, g, or t
  misc_feature (816)..(816): n is a, c, g, or t
  misc_feature (819)..(819): n is a, c, g, or t
  misc_feature (831)..(831): n is a, c, g, or t
  misc_feature (837)..(837): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (858)..(858): n is a, c, g, or t
  misc_feature (861)..(861): n is a, c, g, or t
  misc_feature (867)..(867): n is a, c, g, or t
  misc_feature (870)..(870): n is a, c, g, or t
  misc_feature (876)..(876): n is a, c, g, or t
  misc_feature (879)..(879): n is a, c, g, or t
  misc_feature (885)..(885): n is a, c, g, or t
atgaayacnytnggnathcaygcnytngtntgggcnggngayttyacnwsngcnwsngcnmgnaargtnathgarwsnwsnaarmgngcnggntaygayytngtngarytnwsnytncaygcnccngtnatggayathgcnytnacnmgngayytnytncargarttygayatgcarathgcntgywsnmgnggnytnwsnytngcngcngayathwsnwsngargayccngartgygtnmgnmgnggnathgcnaarytncargarggnathacnatgacngcncarytnggnggnaaytayttyggnggngtnytntayggngcnytngcnaartayccnggnccnytnacngaraarggnmgntayaaygcnatggarwsnatgaarmgnatggcngaygtngcngcngcnaarggnathacnytnggnytngargtngtnaaymgntaygarwsnaaycarytnaayacngcnytncargcnytngaratgytngayaarytnaaygcnccnggngtnaargtncayytngayacntaycayatgaayathgargaracngayttyytncarccngtnytngcntgyggngcnmgnytnggntaygtncayathggngarwsnaaymgnggntayytnggnwsnggnacnathgayttyccngarttyttymgngcnytngcnwsnathggntaygarggngtnathacnttygarwsnttywsnwsngcngtngtnaaycaygayytnwsnaayacnytngcngtntggmgnaayytntggwsngayggnatggayytngcnaarcaygcnmgncarttyathgcngayggnatgggnaaygcnmgnaargcnwsnaaygtnwsnaaygcnwsnaaygcn

SEQ ID NO: 104 - protein, 295 aa, Verminephrobacter eiseniae EF01-2
MNTLGIHALVWAGDFTSASARKVIESSKRAGYDLVELSLHAPVMDIALTRDLLQEFDMQIACSRGLSLAADISSEDPECVRRGIAKLQEGITMTAQLGGNYFGGVLYGALAKYPGPLTEKGRYNAMESMKRMADVAAAKGITLGLEVVNRYESNQLNTALQALEMLDKLNAPGVKVHLDTYHMNIEETDFLQPVLACGARLGYVHIGESNRGYLGSGTIDFPEFFRALASIGYEGVITFESFSSAVVNHDLSNTLAVWRNLWSDGMDLAKHARQFIADGMGNARKASNVSNASNA

SEQ ID NO: 105 - DNA, 873 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (75)..(75): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (177)..(177): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (348)..(348): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (387)..(387): n is a, c, g, or t
  misc_feature (390)..(390): n is a, c, g, or t
  misc_feature (396)..(396): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (495)..(495): n is a, c, g, or t
  misc_feature (501)..(501): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (834)..(834): n is a, c, g, or t
  misc_feature (837)..(837): n is a, c, g, or t
  misc_feature (840)..(840): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (873)..(873): n is a, c, g, or t
atgaayaarytnggngtncaygcnytngtntgggcnggngayytnwsnccngarwsnacnmgnaargcnathacncaracnaargcngcnggnttygayytnathgarytnwsnytncayggnccnaargtnatggayytnwsnytnacnmgngayytnytncargarcayaayytngarathggntgywsnmgnggnytnacnttygaygcngayathwsnwsngargayccngcngtngtnwsnmgnggnatggcnytnytngargarggngtnmgnathacngcngarytnggnggngcntayttyggnggnathytntaywsngcnatgggnaartaycargcnccnathacngcnacnggnmgnmgnaaygcngtngarwsnytnaarmgnathgcngarytngcnytnaaraaraaygtnacnytnggnytngargtngtnaaymgntaygarwsnaayytnytnaayacngcnwsncargcnytnggnatgytngaygarathggngcnccnaaygtngtngtncayytngayacntaycayatgaayathgargartgygayttyatgcarccngtnytncartgyggngcnmgnytnggntaygtncayathggngarwsnaaymgnggntayytnggnwsnggnacnathgayttygcncarttyttycaygcnytngcnatgathgaytayaarggngtnathacnttygarwsnttywsnwsngcngtngtnaaygarcarytnwsnaaygcnytngcnathtggmgnaayytntgggaygaywsnatggayytngcnacncaygcnmgnggnttyathgcnggnggnytnaaygcngcngcnaargcnaarcarcaymgn

SEQ ID NO: 106 - protein, 291 aa, Burkholderia caribensis MBA4
MNKLGVHALVWAGDLSPESTRKAITQTKAAGFDLIELSLHGPKVMDLSLTRDLLQEHNLEIGCSRGLTFDADISSEDPAVVSRGMALLEEGVRITAELGGAYFGGILYSAMGKYQAPITATGRRNAVESLKRIAELALKKNVTLGLEVVNRYESNLLNTASQALGMLDEIGAPNVVVHLDTYHMNIEECDFMQPVLQCGARLGYVHIGESNRGYLGSGTIDFAQFFHALAMIDYKGVITFESFSSAVVNEQLSNALAIWRNLWDDSMDLATHARGFIAGGLNAAAKAKQHR

SEQ ID NO: 107 - DNA, 873 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (75)..(75): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (162)..(162): n is a, c, g, or t
  misc_feature (177)..(177): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (348)..(348): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (387)..(387): n is a, c, g, or t
  misc_feature (390)..(390): n is a, c, g, or t
  misc_feature (396)..(396): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (411)..(411): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (495)..(495): n is a, c, g, or t
  misc_feature (501)..(501): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (834)..(834): n is a, c, g, or t
  misc_feature (837)..(837): n is a, c, g, or t
  misc_feature (840)..(840): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (873)..(873): n is a, c, g, or t
atgaayaarytnggngtncaygcnytngtntgggcnggngayytnwsnccngarwsnacnmgnaargtnathacncaracnaargcngcnggnttygayytnathgarytnwsnytncayggnccnaargtnatggayytnwsnytnacnmgngayatgytncargarcayaayytngarathggntgywsnmgnggnytnacnttygaygcngayathwsnwsngargayccngcngtngtnwsnmgnggnatggcnytnytngargarggngtnmgnathacngcngarytnggnggngcntayttyggnggnathytntaywsngcnatgggnaartaycaygcnccnathacngcnaarggnmgnmgnaaygcngtngarwsnytnaarmgnathgcnggnytngcncaraaraaraaygtnacnytnggnytngargtngtnaaymgntaygarwsnaayytnytnaayacngcnwsncargcnytnggnatgytngaygarathggngcnccnaaygtngtngtncayytngayacntaycayatgaayathgargartgygayttyatgcarccngtnytncartgyggngcnmgnytnggntaygtncayathggngarwsnaaymgnggntayytnggnwsnggnacnathgayttygcncarttyttycaygcnytngcnatgathgaytayaarggngtngtnacnttygarwsnttywsnwsngcngtngtnaaygarcarytnwsnaaygcnytngcnathtggmgnaayytntgggaygaywsnatggayytngcnacncaygcnmgnggnttyathgcnggnggnytnaaygcngcnacnaargcnaarcarcaymgn

SEQ ID NO: 108 - protein, 291 aa, Burkholderia sp. BT03
MNKLGVHALVWAGDLSPESTRKVITQTKAAGFDLIELSLHGPKVMDLSLTRDMLQEHNLEIGCSRGLTFDADISSEDPAVVSRGMALLEEGVRITAELGGAYFGGILYSAMGKYHAPITAKGRRNAVESLKRIAGLAQKKNVTLGLEVVNRYESNLLNTASQALGMLDEIGAPNVVVHLDTYHMNIEECDFMQPVLQCGARLGYVHIGESNRGYLGSGTIDFAQFFHALAMIDYKGVVTFESFSSAVVNEQLSNALAIWRNLWDDSMDLATHARGFIAGGLNAATKAKQHR

SEQ ID NO: 109 - DNA, 873 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (75)..(75): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (177)..(177): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (378)..(378): n is a, c, g, or t
  misc_feature (381)..(381): n is a, c, g, or t
  misc_feature (387)..(387): n is a, c, g, or t
  misc_feature (390)..(390): n is a, c, g, or t
  misc_feature (396)..(396): n is a, c, g, or t
  misc_feature (402)..(402): n is a, c, g, or t
  misc_feature (408)..(408): n is a, c, g, or t
  misc_feature (411)..(411): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (495)..(495): n is a, c, g, or t
  misc_feature (501)..(501): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (834)..(834): n is a, c, g, or t
  misc_feature (837)..(837): n is a, c, g, or t
  misc_feature (840)..(840): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (867)..(867): n is a, c, g, or t
  misc_feature (873)..(873): n is a, c, g, or t
atgaayaarytnggngtncaygcnytngtntgggcnggngayytnwsnccngarwsnacnmgnaargtnathacncaracnaargcngcnggnttygayytnathgarytnwsnytncayggnccnaargtnatggayytnwsnytnacnmgngayytnytncargarcayaayytngarathggntgywsnmgnggnytnacnttygaygcngayathwsnwsngargayccngcngtngtnwsnmgnggnatggcnytnytngargarggngtnmgnathacngcngarytnggnggngcntayttyggnggnathytntaywsngcnatgggnaartaygcngcnccnathacngcnaarggnmgncaraaygcngtngarwsnytnaarmgnathgcngarytngcncaraaraaraaygtnacnytnggnytngargtngtnaaymgntaygarwsnaayytnytnaayacngcnwsncargcnytnggnatgytngaygarathggngcnccnaaygtngtngtncayytngayacntaycayatgaayathgargartgygayttyatgcarccngtnytncartgyggngarmgnytnggntaygtncayathggngarwsnaaymgnggntayytnggnwsnggnacnathgayttygcncarttyttycaygcnytngcnatgathgaytayaarggngtngtnacnttygarwsnttywsnwsngcngtngtnaaygarcarytnwsnaaygcnytngcnathtggmgnaayytntgggaygaywsnatggayytngcngcncaygcnmgnggnttyathgcnggnggnytnaaygcngcnacnaargcnaarytncaymgn

SEQ ID NO: 110 - protein, 291 aa, Burkholderia terrae BS001
MNKLGVHALVWAGDLSPESTRKVITQTKAAGFDLIELSLHGPKVMDLSLTRDLLQEHNLEIGCSRGLTFDADISSEDPAVVSRGMALLEEGVRITAELGGAYFGGILYSAMGKYAAPITAKGRQNAVESLKRIAELAQKKNVTLGLEVVNRYESNLLNTASQALGMLDEIGAPNVVVHLDTYHMNIEECDFMQPVLQCGERLGYVHIGESNRGYLGSGTIDFAQFFHALAMIDYKGVVTFESFSSAVVNEQLSNALAIWRNLWDDSMDLAAHARGFIAGGLNAATKAKLHR

SEQ ID NO: 111 - DNA, 873 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (75)..(75): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (387)..(387): n is a, c, g, or t
  misc_feature (390)..(390): n is a, c, g, or t
  misc_feature (396)..(396): n is a, c, g, or t
  misc_feature (402)..(402): n is a, c, g, or t
  misc_feature (411)..(411): n is a, c, g, or t
  misc_feature (414)..(414): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (495)..(495): n is a, c, g, or t
  misc_feature (501)..(501): n is a, c, g, or t
  misc_feature (510)..(510): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (834)..(834): n is a, c, g, or t
  misc_feature (837)..(837): n is a, c, g, or t
  misc_feature (840)..(840): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (864)..(864): n is a, c, g, or t
  misc_feature (867)..(867): n is a, c, g, or t
atgaayaarytnggngtncaygcnytngtntgggcnggngayytnacnccngarwsnacnmgnaargtnathwsncaracnaargcngcnggnttygayytngtngarytnwsnytncayggnccnaargtnatggayytngcnytnacnmgngayytnytncargarcayggnytngarathggntgywsnmgnggnytnacnytngaygcngaygtnwsnwsngayaayccngarwsngtngcnmgnggnytngcnytnytngargarggngtnwsnathacngcngarytnggnggnaartayttyggnggnathytntayggngcnatggcnaartaycargcnccnytnacngcncarggnmgnmgnaaygcngtngaywsnytnaarmgnathgcngayttygcnytnaaraargaygtnacnytnggnytngargtngtnaaymgntaygarwsnaayytnytnaayacngcnwsncargcnytnggnatgytngaygargtngaygcnccnaaygtngtngtncayytngayacntaycayatgaayathgargarwsngayttyatgcarccngtnytngcntgyggnaarmgnytnggntaygtncayathggngarwsnaaymgnggntayytnggnwsnggnacnathgayttygcncarttyttycaygcnytnwsnatgathggntaygarggngtngtnacnttygarwsnttywsnwsnacngtngtnaaygarcarytnwsnaaygcnytngcnathtggmgnaayytntgggaygaywsnatggayytngcnacncaygcnmgnacnttyathgcnggnggnathaaygcngcngcnaargcnmgngcncaycay

SEQ ID NO: 112 - protein, 291 aa, Burkholderia sordidicola
MNKLGVHALVWAGDLTPESTRKVISQTKAAGFDLVELSLHGPKVMDLALTRDLLQEHGLEIGCSRGLTLDADVSSDNPESVARGLALLEEGVSITAELGGKYFGGILYGAMAKYQAPLTAQGRRNAVDSLKRIADFALKKDVTLGLEVVNRYESNLLNTASQALGMLDEVDAPNVVVHLDTYHMNIEESDFMQPVLACGKRLGYVHIGESNRGYLGSGTIDFAQFFHALSMIGYEGVVTFESFSSTVVNEQLSNALAIWRNLWDDSMDLATHARTFIAGGINAAAKARAHH

SEQ ID NO: 113 - DNA, 873 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (264)..(264): n is a, c, g, or t
  misc_feature (273)..(273): n is a, c, g, or t
  misc_feature (279)..(279): n is a, c, g, or t
  misc_feature (285)..(285): n is a, c, g, or t
  misc_feature (288)..(288): n is a, c, g, or t
  misc_feature (297)..(297): n is a, c, g, or t
  misc_feature (300)..(300): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (366)..(366): n is a, c, g, or t
  misc_feature (369)..(369): n is a, c, g, or t
  misc_feature (378)..(378): n is a, c, g, or t
  misc_feature (387)..(387): n is a, c, g, or t
  misc_feature (402)..(402): n is a, c, g, or t
  misc_feature (411)..(411): n is a, c, g, or t
  misc_feature (414)..(414): n is a, c, g, or t
  misc_feature (426)..(426): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (495)..(495): n is a, c, g, or t
  misc_feature (498)..(498): n is a, c, g, or t
  misc_feature (510)..(510): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (705)..(705): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (819)..(819): n is a, c, g, or t
  misc_feature (822)..(822): n is a, c, g, or t
  misc_feature (834)..(834): n is a, c, g, or t
  misc_feature (837)..(837): n is a, c, g, or t
  misc_feature (840)..(840): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (867)..(867): n is a, c, g, or t
atgaayaarytnggngtncaygcnytngtntgggcnggngayytnacnccngarwsnacnmgnaargtnytnwsnwsnacnaargargcnggnttygayytngcngarytnwsnytncayggnccnaargtnatggayytngcnytnacnmgngayytnytncargarttyggnytngargtnggntgywsnmgnggnytnacnttygargcngaygtnwsnwsngargaygcngcnacngtngcnmgnggngtngcnatgytngargargcnathacnathacnwsngarathggnggnaartayttyggnggnathytntayggngcnatggcnaartaywsngcnccngtnacnaaraarggnmgncaraaygcnathgaywsnathaarcayathgcngayttygcnytnaaraargaygtnaarytnggnytngargtngtnaaymgntaygarwsnaayytnytnaayacngcnwsncargcnytngcnytnathgaygargtnggngcnccnaaygtnggngtncayytngayacntaycayatgaayathgargarwsngayttyatgcarccngtnytncartgyggngaymgnytngcntaygtncayathggngarwsnaaymgnggntayytnggnwsnggnacnathgayttywsncarttyttycaygcnytnwsnatggtnaaytaymgnggngtnathacnttygarwsnttywsnwsnacngtngtnaaygarcarytnwsnaaygcnytngcnathtggmgnaayytntgggaygayggnatggayytngcnaarcaygcnmgngarttyatggcnggnggnathaaygcngcngcnaargcnaargcncaycay

SEQ ID NO: 114 - protein, 291 aa, Burkholderia sp. BT03
MNKLGVHALVWAGDLTPESTRKVLSSTKEAGFDLAELSLHGPKVMDLALTRDLLQEFGLEVGCSRGLTFEADVSSEDAATVARGVAMLEEAITITSEIGGKYFGGILYGAMAKYSAPVTKKGRQNAIDSIKHIADFALKKDVKLGLEVVNRYESNLLNTASQALALIDEVGAPNVGVHLDTYHMNIEESDFMQPVLQCGDRLAYVHIGESNRGYLGSGTIDFSQFFHALSMVNYRGVITFESFSSTVVNEQLSNALAIWRNLWDDGMDLAKHAREFMAGGINAAAKAKAHH

SEQ ID NO: 115 - DNA, 873 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (177)..(177): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (279)..(279): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (411)..(411): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (495)..(495): n is a, c, g, or t
  misc_feature (498)..(498): n is a, c, g, or t
  misc_feature (510)..(510): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (819)..(819): n is a, c, g, or t
  misc_feature (822)..(822): n is a, c, g, or t
  misc_feature (834)..(834): n is a, c, g, or t
  misc_feature (837)..(837): n is a, c, g, or t
  misc_feature (840)..(840): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (864)..(864): n is a, c, g, or t
  misc_feature (867)..(867): n is a, c, g, or t
atgaayaarytnggngtncaygcnytngtntgggcnggngayytnacnccngarwsnacnmgnaargtngtnwsncaracnaargcngcnggnttygayytngtngarytnwsnytncayggnccnaargtnatggayytngcnytnacnmgngayytnytncargarcaycarytngayathggntgywsnmgnggnytnacnttygaygcngaygtnwsnwsngargaywsngcnacngtngcnmgnggngtngcnytnytngargarggnathacnathacngcngarytnggnggncaytayttyggnggnathytntayggngcnatggcnaartaywsngcnccngtnacnaarcarggnmgnmgnaaywsnathgaywsnytnmgnmgnathgcngarttygcncaraaraaraaygtnacnytnggnytngargtngtnaaymgntaygarwsnaayytnytnaayacngcnwsncargcnytngcnytnathgaygargtnaaygcnccnaaygtngtngtncayytngayacntaycayatgaayathgargarwsngayttyatgcarccngtnytngartgyggnaarmgnytnggntaygtncayathggngarwsnaaymgnggntayytnggnwsnggnacnathgayttywsncarttyttycaygcnytngcnatgathggntaycarggngtngtnacnttygarwsnttywsnwsnacngtngtnaaygarcarytnwsnaayacnytngcnathtggmgnaayytntgggaygayggnatggayytngcnaarcaygcnmgngarttyathgcnggnggnathaaygcngcngcnaargcnmgngcncaycay

SEQ ID NO: 116 - protein, 291 aa, Burkholderia sp. YI23
MNKLGVHALVWAGDLTPESTRKVVSQTKAAGFDLVELSLHGPKVMDLALTRDLLQEHQLDIGCSRGLTFDADVSSEDSATVARGVALLEEGITITAELGGHYFGGILYGAMAKYSAPVTKQGRRNSIDSLRRIAEFAQKKNVTLGLEVVNRYESNLLNTASQALALIDEVNAPNVVVHLDTYHMNIEESDFMQPVLECGKRLGYVHIGESNRGYLGSGTIDFSQFFHALAMIGYQGVVTFESFSSTVVNEQLSNTLAIWRNLWDDGMDLAKHAREFIAGGINAAAKARAHH

SEQ ID NO: 117 - DNA, 873 bp, Artificial Sequence
  Synthetic
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (177)..(177): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (279)..(279): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (411)..(411): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (495)..(495): n is a, c, g, or t
  misc_feature (498)..(498): n is a, c, g, or t
  misc_feature (510)..(510): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (696)..(696): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (819)..(819): n is a, c, g, or t
  misc_feature (822)..(822): n is a, c, g, or t
  misc_feature (834)..(834): n is a, c, g, or t
  misc_feature (837)..(837): n is a, c, g, or t
  misc_feature (840)..(840): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (864)..(864): n is a, c, g, or t
  misc_feature (867)..(867): n is a, c, g, or t
atgaayaarytnggngtncaygcnytngtntgggcnggngayytnacnccngarwsnacnmgnaargtngtnwsncaracnaargcngcnggnttygayytngtngarytnwsnytncayggnccnaargtnatggayytngcnytnacnmgngayytnytncargarcaycarytngayathggntgywsnmgnggnytnacnttygaygcngaygtnwsnwsngargaywsngcnacngtngcnmgnggngtngcnytnytngargarggnathacnathacngcngarytnggnggncaytayttyggnggnathytntayggngcnatggcnaartaywsngcnccngtnacnaarcarggnmgnmgnaaywsnathgaywsnytnmgnmgnathgcngarttygcncaraaraaraaygtnacnytnggnytngargtngtnaaymgntaygarwsnaayytnytnaayacngcnwsncargcnytngcnytnathgaygargtnaaygcnccnaaygtngtngtncayytngayacntaycayatgaayathgargarwsngayttyatgcarccngtnytngartgyggnaarmgnytnggntaygtncayathggngarwsnaaymgnggntayytnggnwsnggnacnathgayttywsncarttyttycaygcnytngcnatggtnggntaycarggngtngtnacnttygarwsnttywsnwsnacngtngtnaaygarcarytnwsnaayacnytngcnathtggmgnaayytntgggaygayggnatggayytngcnaarcaygcnmgngarttyathgcnggnggnathaaygcngcngcnaargcnmgngcncaycay

SEQ ID NO: 118 - protein, 291 aa, Burkholderia sp. RPE67
MNKLGVHALVWAGDLTPESTRKVVSQTKAAGFDLVELSLHGPKVMDLALTRDLLQEHQLDIGCSRGLTFDADVSSEDSATVARGVALLEEGITITAELGGHYFGGILYGAMAKYSAPVTKQGRRNSIDSLRRIAEFAQKKNVTLGLEVVNRYESNLLNTASQALALIDEVNAPNVVVHLDTYHMNIEESDFMQPVLECGKRLGYVHIGESNRGYLGSGTIDFSQFFHALAMVGYQGVVTFESFSSTVVNEQLSNTLAIWRNLWDDGMDLAKHAREFIAGGINAAAKARAHH

SEQ ID NO: 119 - DNA, 885 bp, Artificial Sequence
  Synthetic
  misc_feature (9)..(9): n is a, c, g, or t
  misc_feature (12)..(12): n is a, c, g, or t
  misc_feature (15)..(15): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (75)..(75): n is a, c, g, or t
  misc_feature (81)..(81): n is a, c, g, or t
  misc_feature (84)..(84): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (210)..(210): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (285)..(285): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (390)..(390): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (405)..(405): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (495)..(495): n is a, c, g, or t
  misc_feature (507)..(507): n is a, c, g, or t
  misc_feature (510)..(510): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (693)..(693): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (786)..(786): n is a, c, g, or t
  misc_feature (792)..(792): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (825)..(825): n is a, c, g, or t
  misc_feature (834)..(834): n is a, c, g, or t
  misc_feature (840)..(840): n is a, c, g, or t
  misc_feature (843)..(843): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (876)..(876): n is a, c, g, or t
  misc_feature (879)..(879): n is a, c, g, or t
  misc_feature (882)..(882): n is a, c, g, or t
atgaayccnytnggnathcaygcnytngtntgggcnggngayytnggnccngarwsnacnmgnmgngtnathwsncaracnmgnmgngcnggntaygayytnathgarytnwsnytncayggnwsncarytnatggayytngcnytnacnmgngayytnytncargarcayggnytncargtnggntgywsnmgnggnytnacnttygcngcngaygtnwsnwsngargayccncaygtngtngcnmgnggngtngcnytnytngargarggngtnwsnathacncaygcnytnggnggncaytayttyggnggnathytntayggngcnatggcnaartaygcncayccntgyacngtnccnggnmgnmgnaaygcngtngcngcngtnaarmgngtngcngcnttygcnggngarmgnggngtnathytnggnytngargtngtnaaymgntaygarwsnaayytnytnaayacngcnacncargcnytngcnatgathgaygcngtnggngcnccnaaygtnaargtncayytngayacntaycayatgaayathgargargtngayttyatgcarccngtnytngcntgymgngarcarytnggntaygtncayathggngarwsncaymgnggntayytnggnwsnggnacnathgayttygcncarttyttyaargcnytngcnytnathgaytaycarggngtngtnacnttygarwsnttywsnwsnacngtngtnaaygargarytnwsnaaygcnytngcnathtggmgnaayytntggggngayggnatggayytngcnmgncaygcncayggnttyatggtncarggnytncaygcngcnmgnatgggnytngcncaytgygcnccngcnaar

SEQ ID NO: 120 - protein, 295 aa, Verminephrobacter aporrectodeae
MNPLGIHALVWAGDLGPESTRRVISQTRRAGYDLIELSLHGSQLMDLALTRDLLQEHGLQVGCSRGLTFAADVSSEDPHVVARGVALLEEGVSITHALGGHYFGGILYGAMAKYAHPCTVPGRRNAVAAVKRVAAFAGERGVILGLEVVNRYESNLLNTATQALAMIDAVGAPNVKVHLDTYHMNIEEVDFMQPVLACREQLGYVHIGESHRGYLGSGTIDFAQFFKALALIDYQGVVTFESFSSTVVNEELSNALAIWRNLWGDGMDLARHAHGFMVQGLHAARMGLAHCAPAK

SEQ ID NO: 121 - DNA, 867 bp, Artificial Sequence
  Synthetic
  misc_feature (9)..(9): n is a, c, g, or t
  misc_feature (12)..(12): n is a, c, g, or t
  misc_feature (15)..(15): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (783)..(783): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (834)..(834): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (867)..(867): n is a, c, g, or t
atgaayccnytnggnathcaygcnytngtntgggcnggngayytnwsnccngcnwsnacnmgncaygtnathgarcaracnmgncargcnggntaygayytngtngarytnwsnytncayggnccnmgnytnatggayytngcnytnacnmgngayytnytncargarcayggnytnggngtnggntgywsnmgnggnytnacnttygargcngaygtnwsnwsngargayccngcngtngtngcnmgnggnytngcnytnytncargarggngtngayathacngcnmgnytnggnggnmgntayttyggnggnathytntayggngcnatggcnaartayggncayccntgyacnccnmgnggnmgnmgnaaygcnathgargcngtnmgnmgnathgcngayttygcnggngarmgnggngtnacnytnggnytngargtngtnaaymgntaygarwsnaayytnytnaayacngcngcncargcnytngarttyathgaygargtnggncarccncaygtntgygtncayytngayacntaycayatgaayathgargargcngayytngcngcnccngtnytngcntgyggncarmgnytnggntaygtncayathggngaraaycaymgnggntayytnggngcnggncayathgayttygcncarttyttyggngcnytngcncarathggntaycarggnacngtnacnttygarwsnttywsnwsngcnathgtnaaygarcarytnwsnaaygcnytngcnathtggmgnccnatgtgggargayggnatggayytngcnytncaygcnmgnggnttyatggcngayggnytngcnwsngcncarcargcnmgngcn

SEQ ID NO: 122 - protein, 289 aa, Delftia sp. 670
MNPLGIHALVWAGDLSPASTRHVIEQTRQAGYDLVELSLHGPRLMDLALTRDLLQEHGLGVGCSRGLTFEADVSSEDPAVVARGLALLQEGVDITARLGGRYFGGILYGAMAKYGHPCTPRGRRNAIEAVRRIADFAGERGVTLGLEVVNRYESNLLNTAAQALEFIDEVGQPHVCVHLDTYHMNIEEADLAAPVLACGQRLGYVHIGENHRGYLGAGHIDFAQFFGALAQIGYQGTVTFESFSSAIVNEQLSNALAIWRPMWEDGMDLALHARGFMADGLASAQQARA

SEQ ID NO: 123 - DNA, 867 bp, Artificial Sequence
  Synthetic
  misc_feature (9)..(9): n is a, c, g, or t
  misc_feature (12)..(12): n is a, c, g, or t
  misc_feature (15)..(15): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (783)..(783): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (834)..(834): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (867)..(867): n is a, c, g, or t
atgaayccnytnggnathcaygcnytngtntgggcnggngayytnwsnccngcnwsnacnmgncaygtnathgarcaracnmgncargcnggntaygayytngtngarytnwsnytncayggnccnmgnytnatggayytngcnytnacnmgngayytnytncargarcayggnytnggngtnggntgywsnmgnggnytnacnttygargcngaygtnwsnwsngargayccngcngtngtngcnytnggnytngcnytnytncargarggngtngayathacngcnmgnytnggnggnmgntayttyggnggnathytntayggngcnatggcnaartayggncayccntgyacnccncarggnmgnmgnaaygcnathgargcngtnmgnmgnathgcngayttygcnggngarmgnggngtnacnytnggnytngargtngtnaaymgntaygarwsnaayytnytnaayacngcnacncargcnytngarttyathgaygargtnggncarccncaygtntgygtncayytngayacntaycayatgaayathgargargcngayytngcngcnccngtnytngcntgyggncarmgnytnggntaygtncayathggngaraaycaymgnggntayytnggngcnggncayathgayttygcncarttyttyggngcnytngcncarathggntaycarggnacngtnacnttygarwsnttywsnwsngcnathgtnaaygarcarytnwsnaaygcnytngcnathtggmgnccnatgtgggargayggnatggayytngcnytncaygcnmgnggnttyatggcngayggnytngcnwsngcncarcargcnmgngcn

SEQ ID NO: 124 - protein, 289 aa, Delftia sp. Cs1-4
MNPLGIHALVWAGDLSPASTRHVIEQTRQAGYDLVELSLHGPRLMDLALTRDLLQEHGLGVGCSRGLTFEADVSSEDPAVVALGLALLQEGVDITARLGGRYFGGILYGAMAKYGHPCTPQGRRNAIEAVRRIADFAGERGVTLGLEVVNRYESNLLNTATQALEFIDEVGQPHVCVHLDTYHMNIEEADLAAPVLACGQRLGYVHIGENHRGYLGAGHIDFAQFFGALAQIGYQGTVTFESFSSAIVNEQLSNALAIWRPMWEDGMDLALHARGFMADGLASAQQARA

SEQ ID NO: 125 - DNA, 867 bp, Artificial Sequence
  Synthetic
  misc_feature (9)..(9): n is a, c, g, or t
  misc_feature (12)..(12): n is a, c, g, or t
  misc_feature (15)..(15): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (783)..(783): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (834)..(834): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (867)..(867): n is a, c, g, or t
atgaayccnytnggnathcaygcnytngtntgggcnggngayytnwsnccngcnwsnacnmgncaygtnathgarcaracnmgncargcnggntaygayytngtngarytnwsnytncayggnccnmgnytnatggayytngcnytnacnmgngayytnytncargarcayggnytnggngtnggntgywsnmgnggnytnacnttygargcngaygtnwsnwsngargayccngcngtngtngcnmgnggnytngcnytnytncargarggngtngayathacngcnmgnytnggnggnmgntayttyggnggnathytntayggngcnatggcnaartayggncayccntgyacnytncarggnmgnmgnaaygcnathgargcngtnmgnmgnathgcngayttygcnggngarmgnggngtnacnytnggnytngargtngtnaaymgntaygarwsnaayytnytnaayacngcnacncargcnytngarttyathgaygargtnggncarccncaygtntgygtncayytngayacntaycayatgaayathgargargcngayytngcngcnccngtnytngcntgyggncarmgnytnggntaygtncayathggngaraaycaymgnggntayytnggngcnggncayathgayttygcncarttyttyggngcnytngcncarathggntaycarggnacngtnacnttygarwsnttywsnwsngcnathgtnaaygarcarytnwsnaaygcnytngcnathtggmgnccnatgtgggargayggnatggayytngcnytncaygcnmgnggnttyatggcngayggnytngcnmgngcncarcargcnmgngcn

SEQ ID NO: 126 - protein, 289 aa, Delftia acidovorans CCUG 15835
MNPLGIHALVWAGDLSPASTRHVIEQTRQAGYDLVELSLHGPRLMDLALTRDLLQEHGLGVGCSRGLTFEADVSSEDPAVVARGLALLQEGVDITARLGGRYFGGILYGAMAKYGHPCTLQGRRNAIEAVRRIADFAGERGVTLGLEVVNRYESNLLNTATQALEFIDEVGQPHVCVHLDTYHMNIEEADLAAPVLACGQRLGYVHIGENHRGYLGAGHIDFAQFFGALAQIGYQGTVTFESFSSAIVNEQLSNALAIWRPMWEDGMDLALHARGFMADGLARAQQARA

SEQ ID NO: 127 - DNA, 867 bp, Artificial Sequence
  Synthetic
  misc_feature (9)..(9): n is a, c, g, or t
  misc_feature (12)..(12): n is a, c, g, or t
  misc_feature (15)..(15): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (489)..(489): n is a, c, g, or t
  misc_feature (492)..(492): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (783)..(783): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (834)..(834): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (867)..(867): n is a, c, g, or t
atgaayccnytnggnathcaygcnytngtntgggcnggngayytnwsnccngcnwsnacnmgncaygtnathgarmgnacnmgncargcnggntaygayytngtngarytnwsnytncayggnccnmgnytnatggayytngcnytnacnmgngayytnytncargarcayggnytnggngtnggntgywsnmgnggnytnacnttygargcngaygtnwsnwsngargayccnacngtngtngcnmgnggnytngcnytnytncargarggngtngayathacngcnmgnytnggnggnmgntayttyggnggnathytntayggngcnatggcnaartayggncayccntgyacnccncarggnmgnmgnaaygcnathgargcngtnmgnmgnathgcngayttygcnggngarmgnggngtnacnytnggnytngargtngtnaaymgntaygarwsnaayytnytnaayacngcngarcargcnytngarttyathgaygargtnggnaarccnaaygtntgygtncayytngayacntaycayatgaayathgargargcngayytngcngcnccngtnytngcntgyggncarmgnytnggntaygtncayathggngaraaycaymgnggntayytnggngcnggncayathgayttygcncarttyttyggngcnytngcncarathggntaycarggnacngtnacnttygarwsnttywsnwsngcnathgtnaaygarcarytnwsnaaygcnytngcnathtggmgnccnatgtgggargayggnatggayytngcnytncaygcnmgnggnttyatggcngayggnytngcnwsngcncarcargcnmgngcn

SEQ ID NO: 128 - protein, 289 aa, Delftia acidovorans
MNPLGIHALVWAGDLSPASTRHVIERTRQAGYDLVELSLHGPRLMDLALTRDLLQEHGLGVGCSRGLTFEADVSSEDPTVVARGLALLQEGVDITARLGGRYFGGILYGAMAKYGHPCTPQGRRNAIEAVRRIADFAGERGVTLGLEVVNRYESNLLNTAEQALEFIDEVGKPNVCVHLDTYHMNIEEADLAAPVLACGQRLGYVHIGENHRGYLGAGHIDFAQFFGALAQIGYQGTVTFESFSSAIVNEQLSNALAIWRPMWEDGMDLALHARGFMADGLASAQQARA

SEQ ID NO: 129 - DNA, 867 bp, Artificial Sequence
  Synthetic
  misc_feature (9)..(9): n is a, c, g, or t
  misc_feature (12)..(12): n is a, c, g, or t
  misc_feature (15)..(15): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (783)..(783): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (834)..(834): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (867)..(867): n is a, c, g, or t
atgaayccnytnggnathcaygcnytngtntgggcnggngayytnwsnccngcnwsnacnmgncaygtnathgarmgnacnmgncargcnggntaygayytngtngarytnwsnytncayggnccnmgnytnatggayytngcnytnacnmgngayytnytncargarcayggnytnggngtnggntgywsnmgnggnytnacnttygargcngaygtnwsnwsngargayccnwsngtngtngcnmgnggnytngcnytnytncargarggngtngayathacngcnmgnytnggnggnmgntayttyggnggnathytntayggngcnatggcnaartayggncayccntgyacnccncarggnmgnmgnaaygcnathgargcngtnmgnmgnathgcngayttygcnggngarmgnggngtnacnytnggnytngargtngtnaaymgntaygarwsnaayytnytnaayacngcngcncargcnytngarttyathgaygargtnggncarccncaygtntgygtncayytngayacntaycayatgaayathgargargcngayytngcngcnccngtnytngcntgyggncarmgnytnggntaygtncayathggngaraaycaymgnggntayytnggngcnggncayathgayttygcncarttyttyggngcnytngcncarathggntaycarggnacngtnacnttygarwsnttywsnwsngcnathgtnaaygarcarytnwsnaaygcnytngcnathtggmgnccnatgtgggargayggnatggayytngcnytncaygcnmgnggnttyatggcngayggnytngcnwsngcncarcargcnmgngcn

SEQ ID NO: 130 - protein, 289 aa, Delftia acidovorans SPH-1
MNPLGIHALVWAGDLSPASTRHVIERTRQAGYDLVELSLHGPRLMDLALTRDLLQEHGLGVGCSRGLTFEADVSSEDPSVVARGLALLQEGVDITARLGGRYFGGILYGAMAKYGHPCTPQGRRNAIEAVRRIADFAGERGVTLGLEVVNRYESNLLNTAAQALEFIDEVGQPHVCVHLDTYHMNIEEADLAAPVLACGQRLGYVHIGENHRGYLGAGHIDFAQFFGALAQIGYQGTVTFESFSSAIVNEQLSNALAIWRPMWEDGMDLALHARGFMADGLASAQQARA

SEQ ID NO: 131 - DNA, 867 bp, Artificial Sequence
  Synthetic
  misc_feature (9)..(9): n is a, c, g, or t
  misc_feature (12)..(12): n is a, c, g, or t
  misc_feature (15)..(15): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (783)..(783): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (834)..(834): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (867)..(867): n is a, c, g, or t
atgaayccnytnggnathcaygcnytngtntgggcnggngayytnwsnccngcnwsnacnmgncaygtnathgarcaracnmgncargcnggntaygayytngtngarytnwsnytncayggnccnmgnytnatggayytngcnytnacnmgngayytnytncargarcayggnytnggngtnggntgywsnmgnggnytnacnttygargcngaygtnwsnwsngargayccnwsngtngtngcnmgnggnytngcnytnytncargarggngtngayathacngcnmgnytnggnggnmgntayttyggnggnathccntayggngcnatggcnaartayggncayccntgywsnccnmgnggnmgnmgnaaygcnathgargcngtnmgnmgnathgcngayttygcnggngarmgnggngtnacnytnggnytngargtngtnaaymgntaygarwsnaayytnytnaayacngcngcncargcnytngarttyathgaygargtnggncarccncaygtntgygtncayytngayacntaycayatgaayathgargargcngayytngcngcnccngtnytngcntgyggncarmgnytnggntaygtncayathggngaraaycaymgnggntayytnggngcnggncayathgayttygcncarttyttyggngcnytngcncarathggntaycarggnacngtnacnttygarwsnttywsnwsngcnathgtnaaygarcarytnwsnaaygcnytngcnathtggmgnccnatgtgggargayggnatggayytngcnytncaygcnmgnggnttyatggcngayggnytngcnwsngcncarcargcnmgngcn

SEQ ID NO: 132 - protein, 289 aa, Delftia acidovorans CCUG 274B
MNPLGIHALVWAGDLSPASTRHVIEQTRQAGYDLVELSLHGPRLMDLALTRDLLQEHGLGVGCSRGLTFEADVSSEDPSVVARGLALLQEGVDITARLGGRYFGGIPYGAMAKYGHPCSPRGRRNAIEAVRRIADFAGERGVTLGLEVVNRYESNLLNTAAQALEFIDEVGQPHVCVHLDTYHMNIEEADLAAPVLACGQRLGYVHIGENHRGYLGAGHIDFAQFFGALAQIGYQGTVTFESFSSAIVNEQLSNALAIWRPMWEDGMDLALHARGFMADGLASAQQARA

SEQ ID NO: 133 - DNA, 867 bp, Artificial Sequence
  Synthetic
  misc_feature (9)..(9): n is a, c, g, or t
  misc_feature (12)..(12): n is a, c, g, or t
  misc_feature (15)..(15): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (345)..(345): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (468)..(468): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (525)..(525): n is a, c, g, or t
  misc_feature (531)..(531): n is a, c, g, or t
  misc_feature (537)..(537): n is a, c, g, or t
  misc_feature (543)..(543): n is a, c, g, or t
  misc_feature (567)..(567): n is a, c, g, or t
  misc_feature (573)..(573): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (597)..(597): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (624)..(624): n is a, c, g, or t
  misc_feature (636)..(636): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (687)..(687): n is a, c, g, or t
  misc_feature (690)..(690): n is a, c, g, or t
  misc_feature (699)..(699): n is a, c, g, or t
  misc_feature (708)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (738)..(738): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (780)..(780): n is a, c, g, or t
  misc_feature (783)..(783): n is a, c, g, or t
  misc_feature (798)..(798): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (822)..(822): n is a, c, g, or t
  misc_feature (825)..(825): n is a, c, g, or t
  misc_feature (834)..(834): n is a, c, g, or t
  misc_feature (840)..(840): n is a, c, g, or t
  misc_feature (843)..(843): n is a, c, g, or t
  misc_feature (846)..(846): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (867)..(867): n is a, c, g, or t
atgaayccnytnggnathcaygcnytngtntgggcnggngayytnwsnccngcnwsnacnmgncaygtnathgarcaracnmgncargcnggntaygayytngtngarytnwsnytncayggnccnmgnytnatggayytngcnytnacnmgngayytnytncargarcaywsnytnggngtnggntgywsnmgnggnytnacnttygargcngaygtnwsnwsngargayccnwsngtngtngcnmgnggnytngcnytnytncargarggngtngayathacngcnmgnytnggnggnmgntayttyggnggnathytntayggngcnatggcnaartayggncayccntgyacnccncarggnmgnmgnaaygcnathgargcngtnmgnmgnathgcngayttygcnggngarmgnggngtnacnytnggnytngargtngtnaaymgntaygarwsnaayytnytnaayacngcngcncargcnytngarttyathgaygargtnggncarccncaygtntgygtncayytngayacntaycayatgaayathgargargcngayytngcngcnccngtnytngcntgyggncarmgnytnggntaygtncayathggngaraaycaymgnggntayytnggngcnggncayathgayttygcncarttyttyggngcnytngcncarathggntaycarggnacngtnacnttygarwsnttywsnwsngcnathgtnaaygarcarytnwsnaaygcnytngcnathtggmgnccnatgtgggargayggnatggayytngcnytncaygcnmgnggnttyatggcngayggnytngcnwsngcncaycargcnmgngcn

SEQ ID NO: 134 - protein, 289 aa, Delftia sp. RIT313
MNPLGIHALVWAGDLSPASTRHVIEQTRQAGYDLVELSLHGPRLMDLALTRDLLQEHSLGVGCSRGLTFEADVSSEDPSVVARGLALLQEGVDITARLGGRYFGGILYGAMAKYGHPCTPQGRRNAIEAVRRIADFAGERGVTLGLEVVNRYESNLLNTAAQALEFIDEVGQPHVCVHLDTYHMNIEEADLAAPVLACGQRLGYVHIGENHRGYLGAGHIDFAQFFGALAQIGYQGTVTFESFSSAIVNEQLSNALAIWRPMWEDGMDLALHARGFMADGLASAHQARA

SEQ ID NO: 135 - DNA, 900 bp, Artificial Sequence
  Synthetic
ggatccatgcaacacggaatttattacgcgtattgggagcatgagtgggacggcgattatcattattatattgataaagtcgcaaaactggggtacgacatcttagagattgccgccggtccgttaccggagtattccgatggtgacttaaaagcactcaaagaacacgctaaagaacagaacattcgtctaacggtcggatatggaccggcgccagagaataacattgcttctagtgatccacaagtccgtaaacatgccctagcgttttatacggatctattccagcgtatggaaaaaattggagcgactctcattgggggagcattatactcatgttggccgattgattatagtaaaccggtagataagaaaggtgactgggagaggggaattgaagggatggcgaagttaggaaaaattgcgagtgagtgtggtattgaagtcttaggtcttgaatgtttaaaccgtttcgagaatcatgtcttaaatactgcagctgagggtgtttcctttgttaaatcagtacgcgagttggagccaaaagcgagcaatgtaagcgtcatgttagatacttttcacatgaatattgaagaagaatcgattggagcagcgattcgcacagccggatctttactgggtcattttcataccggagagtgcaatcgtatggtgccaggaaagggtcgcactccgtggcgggaaatcggtgaagcattgagagatattcaatatgataaaaccgtagtaatggaaccctttgttatgccgggtggaacggtaggacaaaacattaaaatttggagagatatcgtacctgacaccagtgaagaagcattagatcgcgatgcgaaagccgccctggaattcgagcgttacatgttaggttgataacccggg

SEQ ID NO: 136 - protein, 294 aa, Roseburia sp. CAG_18
MQHGIYYAYWEHEWDGDYHYYIDKVAKLGYDILEIAAGPLPEYSDGDLKALKEHAKEQNIRLTVGYGPAPENNIASSDPQVRKHALAFYTDLFQRMEKIGATLIGGALYSCWPIDYSKPVDKKGDWERGIEGMAKLGKIASECGIEVLGLECLNRFENHVLNTAAEGVSFVKSVRELEPKASNVSVMLDTFHMNIEEESIGAAIRTAGSLLGHFHTGECNRMVPGKGRTPWREIGEALRDIQYDKTVVMEPFVMPGGTVGQNIKIWRDIVPDTSEEALDRDAKAALEFERYMLG

SEQ ID NO: 137 - DNA, 888 bp, Artificial Sequence
  Synthetic
ggatccatgaataaagtcggaatgttttacacttattggagtacggaatggttggtagatttcccagcggtggcgaagcgcatttctggtttagggtttgacatgatggaaatttcattatctgagtttcataatttaccagacgcgaaaaaacgtgaactcaaaacggttgcagatgatttagggctaaccgttatgtgttgtattggattaaaaccggagtatgacttcgcgagcccagagcagagtgtacgggatgccggaactgaatatgttaaacatttgcttgatgactgtcacatgctcggagcaccagtattcgccggtttaaccttttgcgcttggccgcaaagtccgccgccgggaatgaaagataaacgtccctatgttgaacgtgcggtcgattccgtcaggcgcgtcattaaagtcgccgaggggtatggaatcatttacgcattagaagtcgtaaatcgtttcgagcaatggttagcgaatgatgctcgtgaagcgctggccttttgtgacgctgtagataacccgtggtgtaaagtccagcttgatacatttcacatgaacattgaagagaacagtttccgggacgcgattctggcctgtcgcggtcgtttaggacactttcatctaggtgaggcaaaccgcttaccgcctggtgagggtcgcttaccctgggatgaaatctttggagcattaaaagaaattgactatgatggaacgattgtaatggaaccgtttatgcgtccgggtggctcggtatctcgtgccgtcggtgtatggcgtgatatgagcaatggtgcaactgatgagcaaatggatgagagagcgcgcagatcattgaattttgtcaggggacatttagcatgataacccggg

SEQ ID NO: 138 - protein, 290 aa, Burkholderia sp. RPE64
MNKVGMFYTYWSTEWLVDFPAVAKRISGLGFDMMEISLSEFHNLPDAKKRELKTVADDLGLTVMCCIGLKPEYDFASPEQSVRDAGTEYVKHLLDDCHMLGAPVFAGLTFCAWPQSPPPGMKDKRPYVERAVDSVRRVIKVAEGYGIIYALEVVNRFEQWLANDAREALAFCDAVDNPWCKVQLDTFHMNIEENSFRDAILACRGRLGHFHLGEANRLPPGEGRLPWDEIFGALKEIDYDGTIVMEPFMRPGGSVSRAVGVWRDMSNGATDEQMDERARRSLNFVRGHLA

SEQ ID NO: 139 - DNA, 885 bp, Artificial Sequence
  Synthetic
ggatccatgaaacacggtatttactatgcatactgggagcaagagtgggcagcagactataaacggtatgtagaaaaagtcgcgaaactgggatttgatattttagaaatcggagccgcgccgttaccagattattctgcacaggaagtcaaagaattaaaaaaatgtgccgatgataatgggattcaattaactgcgggttatggaccgacgtttaatcataacatgggtagtagcgaccccaaaattcgcgaagaagccttggagtggtataaacgtctgtttgaagtcatggctggtttagacattcatctcattggtggagcactatacagttattggccggtagattttgccacggctaacaaagaagaggactggaaacattccgtagagggaatgcagattttggcgccgattgccagtcaatatggaatcaacctgggaatggaagtattaaatcgctttgagtcacacattttgaatacaagcgaagaaggcgtcaaatttgtcaccgaggttggaatggataacgtaaaagttatgctagatacctttcacatgaatattgaagagtcaagtattggggatgcgattagacatgcggggaaattacttggacatttccatacgggtgagtgtaaccgtatggtcccaggaaagggtaggactccgtggcgcgagattggtgatgctttacgcgagatcgagtacgatggaactgttgtcatggaacctttcgtacgtatgggtggacaagtgggatccgacattaaagtctggagagatatttctaagggtgcggatgaagaacaattagacgaagatgcgcgtcgtgcagtagagttccagcgttatatgttagagtggaaatgataacccggg

SEQ ID NO: 140 - protein, 289 aa, Clostridiales bacterium VE202-26
MKHGIYYAYWEQEWAADYKRYVEKVAKLGFDILEIGAAPLPDYSAQEVKELKKCADDNGIQLTAGYGPTFNHNMGSSDPKIREEALEWYKRLFEVMAGLDIHLIGGALYSYWPVDFATANKEEDWKHSVEGMQILAPIASQYGINLGMEVLNRFESHILNTSEEGVKFVTEVGMDNVKVMLDTFHMNIEESSIGDAIRHAGKLLGHFHTGECNRMVPGKGRTPWREIGDALREIEYDGTVVMEPFVRMGGQVGSDIKVWRDISKGADEEQLDEDARRAVEFQRYMLEWK

SEQ ID NO: 141 - DNA, 900 bp, Artificial Sequence
  Synthetic
ggatccatgaaccctatcggaatgcactacggattttggagtcacaattgggatgaaattgcgtatattccgttaatggaaaaattagcgtggctgggatttgatatttgtgaagttgcaagtgcagagtggggttattacgatgatgcgagattacgcgagctgaaagcctgtgccgatcataatggtttaggtatcacttattctattggattggaagcaaaatatgacctagctagtgatgacccagcagtccgagagaatggaattcgtcatgtgactcggattttagaatccatgccgaaagtcggtgcagcgattctgaatggtgtatcgtatgccggatggcaagcgttaccggaccatggaattacgttagatgagaaacgccgtaaggaagaactcgcgttagagtctatgtcacgtctaatgaaagtcgccgaggactgtggagtactctattgctgtgaagttgtcaatcgttttgagcagtatcttcttaacaccgcaaaagagggtgtagagtttgtaaaacgcttgggttcaccaaacgcacgtgtcttattagatacatttcacatgaacattgaagaagatagcatggtagatgcgattttagaggccggaccgtggttgggacatttccatgttggtgaaaataaccgcaggccggccgggagcacgaatagattaccctggaaagatatggcagctgcgctaaaacaagtaaattaccagggtgctattgtcatggaacccttcgtcttaatgggtgggaccattccgtatgacattaaggtatggcgtgatttatccggtggggctggagaggccgggttagatgaaatggccggacgggcgtgtcgtttcctaaaagaattaactgcgtgataacccggg

SEQ ID NO: 142 - protein, 294 aa, Flavonifractor plautii ATCC 29863
MNPIGMHYGFWSHNWDEIAYIPLMEKLAWLGFDICEVASAEWGYYDDARLRELKACADHNGLGITYSIGLEAKYDLASDDPAVRENGIRHVTRILESMPKVGAAILNGVSYAGWQALPDHGITLDEKRRKEELALESMSRLMKVAEDCGVLYCCEVVNRFEQYLLNTAKEGVEFVKRLGSPNARVLLDTFHMNIEEDSMVDAILEAGPWLGHFHVGENNRRPAGSTNRLPWKDMAAALKQVNYQGAIVMEPFVLMGGTIPYDIKVWRDLSGGAGEAGLDEMAGRACRFLKELTA

SEQ ID NO: 143 - DNA, 900 bp, Artificial Sequence
  Synthetic
ggatccatgaatcaattcggaattcattatgcgtattggggaaacgaatggaaagtcgacatgtgtgagagaatccggctagcagcggacgctgggtttgatgatttagaagtcactcccccggatttcatgacgaatttagagaaagacaaaatgaatgaattaaaacagtgcgcgagtgattatggcgttgagatgtctttttgtattggatttccgaaatctaaagacatggcatcaccagatccgaaagttcgtcaggctggaatcgactatagtaagcgcatgattgaagctgccgagtacatgggtgggaaaattttgtcaggtattttatattcctggtggccatatttatacgattctgagattactccgcaatacaaacgtgattgttggaagcgtggagtggagagcgttcgtcaagtaattccatttgcggcggatgctggtatggtctatgccattgagcttgtcaatcgctttgaacaattcattgtaaacaccgtcgccgagggtcgccaatttattgcggacatcggacatcctaatgcaaaattattattagatgtatttcatgcgaatattgaagaagattccatcccagacgcaattcgtagtgcaggaccgctcttagcacatattcacatgagcgaagccaacaggcgtctgccgggttgtggtggaaatattccctgggcccagattgcccaagcactgaaagatattaactaccagggtagaattgtattggaaccgttcgtagcggcgggtggaccggtcggaaacgatctacgtatttggcgtgatctagatgcagatgtaagtaaagaagcgcgccacgagaacttaaagaaatcattaaaatttgtaaaagaattaatgaaatgataacccggg

SEQ ID NO: 144 - protein, 294 aa, Anaerotruncus colihominis DSM 17241
MNQFGIHYAYWGNEWKVDMCERIRLAADAGFDDLEVTPPDFMTNLEKDKMNELKQCASDYGVEMSFCIGFPKSKDMASPDPKVRQAGIDYSKRMIEAAEYMGGKILSGILYSWWPYLYDSEITPQYKRDCWKRGVESVRQVIPFAADAGMVYAIELVNRFEQFIVNTVAEGRQFIADIGHPNAKLLLDVFHANIEEDSIPDAIRSAGPLLAHIHMSEANRRLPGCGGNIPWAQIAQALKDINYQGRIVLEPFVAAGGPVGNDLRIWRDLDADVSKEARHENLKKSLKFVKELMK

SEQ ID NO: 145 - DNA, 894 bp, Artificial Sequence
  Synthetic
ggatccatgaaatttggaacatattttgcatattgggagcagagctgggacacggattacttgaaatacgtcaaaaaagtcgcggacttaggttttgatgtcttagaggttggagcggcgggaattgttaatatgtctgatgatgcgctgagtgcgcttaaatccgaggcagagaactatgctattaccttaactgcaggcattggattaccaaaacagtttgatgtatcgtccgagaatgaatcagttaggcaagatggaattgcgttcatgaagaaaattttagacgccctacataaagctggaattaaagcgattggtggaacgatctatagttattggcccgtcgactatagtgcaccgattaacaaaccggcagttcgtaaacaaagcattaaatcaatgcaagaactcgccgattacgccgcacaatatgacattactttacttgtggagtctttaaacagatttgaacaattcttggtaaatgatgccaaagaagctgtagattatgtcaaagccgtaaacaaaccgaatgtaaaagtaatgctagattccttccacatgaatatcgaagaagattacttgggtgatgcgattcgttatactggagactatttagggcattttcatatcggggagtgtaatcgcaaggtccctggaaaagggcacatgccgtggtctgaaattggtcaggcattacgcgatattcagtacgatggttgtgtggtaatggaacccttcgtccggccgggtggaattgtcggtagtgatattaaggtatggcgtgatctgagtgacaatgcagacgaagcgaaattagacgccgatattaaagaatcattagagtttgtcaaacaaacgtttctgaaatcaaccccatgataacccggg

SEQ ID NO: 146 - protein, 292 aa, Paenibacillus senegalensis
MKFGTYFAYWEQSWDTDYLKYVKKVADLGFDVLEVGAAGIVNMSDDALSALKSEAENYAITLTAGIGLPKQFDVSSENESVRQDGIAFMKKILDALHKAGIKAIGGTIYSYWPVDYSAPINKPAVRKQSIKSMQELADYAAQYDITLLVESLNRFEQFLVNDAKEAVDYVKAVNKPNVKVMLDSFHMNIEEDYLGDAIRYTGDYLGHFHIGECNRKVPGKGHMPWSEIGQALRDIQYDGCVVMEPFVRPGGIVGSDIKVWRDLSDNADEAKLDADIKESLEFVKQTFLKSTP

SEQ ID NO: 147 - DNA, 921 bp, Artificial Sequence
  Synthetic
ggatccatgagatattttaaagaagaggtagcgggaatgaaatatggaatttactttgcatattggactaaagagtggtttgcggattacaaaaaatacatggacaaagtttccgcgcttggatttgacgtattagagattagctgtgcggcacttcgtgatgtttatacgacaaaagaacaattaatcgagttacgcgagtatgccaaagagaaaggtctagtgttgactgctggatacggacctaccaaagccgagaatttatgttccgaggatccggaagccgtccgtcgtgcaatgactttctttaaagacttactcccaaaattacagttaatggacattcatattctgggtgggggactgtacagttattggccggtagattttacaattaacaatgacaaacagggtgatagggcacgcgcggtcagaaacttgcgtgaattatcaaaaaccgctgaagagtgtgatgtcgtcctaggaatggaagtactgaatcgctatgaagggtatattttaaacacttgcgaggaagccatcgattttgtcgatgaaattggttctagtcatgtaaaaattatgctcgatacgttccacatgaatattgaagaaacgaatatggctgacgcgattcggaaagccggggatcgtctgggacatttacacttaggtgaacaaaatcgcttagtaccgggaaagggtagccttccctgggcagagattggacaagcattacgtgatattaactatcagggtgctgccgtcatggaaccgtttgtcatgcaaggtggaacgattggttcagagattaaagtctggcgcgatatggtaccggatctatctgaagaagcattggatcgtgatgcgaagggtgcgttagagttttgtcgccatgtattcggcatttgataacccggg

SEQ ID NO: 148 - protein, 291 aa, Clostridium bolteae ATCC BAA-613
MKYGIYFAYWTKEWFADYKKYMDKVSALGFDVLEISCAALRDVYTTKEQLIELREYAKEKGLVLTAGYGPTKAENLCSEDPEAVRRAMTFFKDLLPKLQLMDIHILGGGLYSYWPVDFTINNDKQGDRARAVRNLRELSKTAEECDVVLGMEVLNRYEGYILNTCEEAIDFVDEIGSSHVKIMLDTFHMNIEETNMADAIRKAGDRLGHLHLGEQNRLVPGKGSLPWAEIGQALRDINYQGAAVMEPFVMQGGTIGSEIKVWRDMVPDLSEEALDRDAKGALEFCRHVFGI

SEQ ID NO: 149 - DNA, 894 bp, Artificial Sequence
  Synthetic
ggatccatgggaagattattatatgcagtacatgcctacgcctggacatcacgctggacgaaagaatccttacctttgttatcgcgtgcacgtgagttaggttttgacgcgatcgagattcccttaatggatattgagagtgtacatccgcaatcaattcgtaaagaggccgaacgtctgggactacgcattgtcacttcaaccgtattaagcgaagagacagatgtttcatctccagatgccgcagtccggcgtaaagggttagaatatcttaaacgctgcgtcgacgtttccgcagagatgggagccttaagttttagcggagtgatttattccgcgctgggtaaacggattgcggcgattccgggaagggaatatttagaacgcgcggctgaggctctgaaaaaagtcgcgcagtgggcgcaagatgcgcaactactcgtaggcattgaaccggtcaatcgttatgaaactttccttatcaatacttgtgaccaagcgctagagttattgaagatgattgatgagccgaatatgcgtatccatttggatagctaccacatgaacattgaagagaacgatttttatactccgacgaaaaaagcaattccatatctctgtcattaccatttgtctgaaagtcataggggaattccgggtacgggtacggtagactgggaagggatttttcgcgcattagccgagggtgattaccgtggtgtcgtaggaatggaaagttttgccgaagttagtgattctatgcgtgcgggtacctgtgtctggagaaaaatggcgcccagttccgatgtcttattacgcgagggattagcattcttaaaagctctggagaaacgtcactttgcaccatctggtggaaagaaatgataacccggg

SEQ ID NO: 150 - protein, 292 aa, Candidatus Caldatribacteirum californiense
MGRLLYAVHAYAWTSRWTKESLPLLSRARELGFDAIEIPLMDIESVHPQSIRKEAERLGLRIVTSTVLSEETDVSSPDAAVRRKGLEYLKRCVDVSAEMGALSFSGVIYSALGKRIAAIPGREYLERAAEALKKVAQWAQDAQLLVGIEPVNRYETFLINTCDQALELLKMIDEPNMRIHLDSYHMNIEENDFYTPTKKAIPYLCHYHLSESHRGIPGTGTVDWEGIFRALAEGDYRGVVGMESFAEVSDSMRAGTCVWRKMAPSSDVLLREGLAFLKALEKRHFAPSGGKK

SEQ ID NO: 151 - DNA, 903 bp, Artificial Sequence
  Synthetic
ggatccatgaacaaaattggaatttttatgaacttttgggtcaaaaactgggatgcggatcatgtaaagtacattaaaaaagtatcgggactgggtttcgatattcttgagttccaagcacaggcattattggatatggataaatcacgcatggacgaagtcagacaagctgcgaaagacaatggaattgagttaacttatagtttagggctaaatcccaaatatgacgttgcaagcccggatgcgaaagtccgcgagggtggaattgaatatttaaaacgtattgtagaacggattggttatatggaagggaaattactctccggtgtcaattatgcgggatggggaagcccggactatattgtagatgataagagtgagattgtaaaacattctattgagagtgtcaggcaagtgatcaaaacggctgaagattatgatgtcacatattgtgtcgaagttgtaaatcgtttcgagggaattgtcatgaataccgcaaaagaggccattgaatacgtaaaacaaattgactccgacaagattggaattctcctagatacgtatcacatgaacatcgaagagggatcaatcggtgatgcgattagaagtgtcggtgggtacttaaaaaacttccatactggagagaataatcgtgtagtccctgggaaaggtcatttagactgggatgaaatctttggagcattacacgatattgattaccagggtcgtattgtgtctgaaccatttgtccaaatgggtggagaggttggccgcgatattaaagtttggcgtgacttagtagaggatccgtcagaagaattgttagatgaagaagcccgctttttgctgaattttgagaaagacatgattcgtaaacattatggtattgcctgataacccggg

SEQ ID NO: 152 - protein, 295 aa, Clostridium scindens
MNKIGIFMNFWVKNWDADHVKYIKKVSGLGFDILEFQAQALLDMDKSRMDEVRQAAKDNGIELTYSLGLNPKYDVASPDAKVREGGIEYLKRIVERIGYMEGKLLSGVNYAGWGSPDYIVDDKSEIVKHSIESVRQVIKTAEDYDVTYCVEVVNRFEGIVMNTAKEAIEYVKQIDSDKIGILLDTYHMNIEEGSIGDAIRSVGGYLKNFHTGENNRVVPGKGHLDWDEIFGALHDIDYQGRIVSEPFVQMGGEVGRDIKVWRDLVEDPSEELLDEEARFLLNFEKDMIRKHYGIA

SEQ ID NO: 153 - DNA, 894 bp, Artificial Sequence
  Synthetic
gcaatgaaacatggaatttattacgcatattgggaacaagagtgggaagctgactacaaatattacattgaaaaagtcgccaaattgggttttgatatcttagaaattgcggcaagcccgcttccattctattctgatattcagattaacgaactgaaagcgtgtgcgcacggaaatgggattactttaacggtcgggcatggtccgtcagcagagcagaatctcagtagtcccgatccggacattcgcaaaaacgcgaaagctttttatacagacctgttaaaaagattgtataaactcgacgtccatttaattggtggagccttatatagctattggcctattgattatactaaaaccattgataagaaaggtgactgggaacgtagcgttgagtcagtacgcgaagtcgcgaaagttgccgaggcatgtggagtggatttttgtttagaagtactaaaccgtttcgagaattacttaattaacacggcgcaagaaggtgtagattttgtaaaacaagtcgatcacaacaatgttaaggttatgttggatacttttcacatgaatatcgaagaggatagtatcggtggagcgattagaaccgcaggatcctatcttggacatctacatacgggagagtgcaatcggaaagtaccgggtcggggtcgtattccatgggtcgaaattggagaggccttagccgatattggatataatggttctgtagtaatggaaccgtttgtacgcatgggtggaacggtcggatcaaacattaaagtctggcgtgatatttctaatggcgcggatgagaaaatgttagaccgtgaggcgcaagctgcattagatttctccaggtacgtattagagtgtcataaacatagttgataacccggg

SEQ ID NO: 154 - protein, 293 aa, Clostridium Cellulolyticum H10
MKHGIYYAYWEQEWEADYKYYIEKVAKLGFDILEIAASPLPFYSDIQINELKACAHGNGITLTVGHGPSAEQNLSSPDPDIRKNAKAFYTDLLKRLYKLDVHLIGGALYSYWPIDYTKTIDKKGDWERSVESVREVAKVAEACGVDFCLEVLNRFENYLINTAQEGVDFVKQVDHNNVKVMLDTFHMNIEEDSIGGAIRTAGSYLGHLHTGECNRKVPGRGRIPWVEIGEALADIGYNGSVVMEPFVRMGGTVGSNIKVWRDISNGADEKMLDREAQAALDFSRYVLECHKHS

SEQ ID NO: 155 - DNA, 879 bp, Artificial Sequence
  Synthetic
ggatccatgagaactttaggtatttattacggattttggacgcatgattgggatgtagactttttaccattcgttagcaaggtaaaagaactgggtttcgatcaattagaagtaaatggtggaacgctagtctcctggaaagaggccgatcgcctcaccttagtagaggaagccaggaaagagggaattttgttatcttatggacttggaatgactgccgagcatgacgtcagcagtccctgtgaagaaattcgccaaaatggaatcagattcatgaaagatatgattaaaatggtcgggcgcatgggtgggggaatgattggtggatcaacgtactgttcatggccaaaacaattaccgaagggtgatagcaaaaaagaatatcaggatcaatccttgaaatctatgaaagaattagtcaaagtcgcagaggataatgaagtaattttaaatctagaagtactgaatcgtttcgagcaatttttatttaacacctgtgaagaaattctgccatttgttgaagaaattggatcaccgaactgcggtatcttattagatacttttcacatgaacattgaagaggattctttgccagtggcaatccagcttgcgggtagtcacctcaaagcgttacatattggggagacaaatcggaaacccgtcggactgggtcgccagccttggaaagaaattcgtagtgcgttagacgcaattggattcgatggcccgttggtcgaggaaccgtttgtattaccgggtgggcaagtgggacaagacattagtgtttggcgcaacttattcgacaatccggatctagataaattagctgcggattcggctgcatttgcccgtcgtactctgattttatgataacccggg

SEQ ID NO: 156 - protein, 287 aa, Sphaerochaeta pleomorpha str. Grapes
MRTLGIYYGFWTHDWDVDFLPFVSKVKELGFDQLEVNGGTLVSWKEADRLTLVEEARKEGILLSYGLGMTAEHDVSSPCEEIRQNGIRFMKDMIKMVGRMGGGMIGGSTYCSWPKQLPKGDSKKEYQDQSLKSMKELVKVAEDNEVILNLEVLNRFEQFLFNTCEEILPFVEEIGSPNCGILLDTFHMNIEEDSLPVAIQLAGSHLKALHIGETNRKPVGLGRQPWKEIRSALDAIGFDGPLVEEPFVLPGGQVGQDISVWRNLFDNPDLDKLAADSAAFARRTLIL

SEQ ID NO: 157 - DNA, 912 bp, Artificial Sequence
  Synthetic
ggatccatgaataaaattggaatttactttgcgttttgggagaaagagtgggaagcggactattgccgttacattgagaaagcaaaaaaattgggatttgacgtcttagagttagcggctgggtgtttaccggatatgaccgcagcacaacgtcgcgagatcgcgtcacgcgctgaagatgcgggtattgatttaacgtactgtatcggactgccaccgcagtatgatttggcgtgtgaagatgcttctgtaagagcgagtggtattcgttatgtcggagagctattaaaatgcattcgccaaatgggtggagacacgctgggtggaatcatttactcttgttggcccggcggaacagtaacttatgactataaacaaaaagcgcgcgaacgctcgttggatagcttacgtgagctgtcccacatggccgaggaatatgacattaactattgtttagaaattgttaaccggtatgagcaatacttattaaatacggcagccgagggtgccgatttcgtgcgcgagttagatagtccaaaagttaaattacttttagattgtttccacatgaatattgaagaagattcattttctgaggccattaagactgccggtgaattactcggacattttcatattggagagtgtaataggaaagtacctggtaggggtcacatggattgggatgatatgattcggggactaagagacattgactattcaggtaagattgtaatggaaccgttcgtacgtccggggggacaggtcggaaaagatattaaaatttatcgtgatcagtccggtaacgctagcgaagcacaaatggatgaaatggcagaagaagcactaacctttattcgtgagaaattacgtagtggtggaaaccaagacgggaaaaattgataacccggg

SEQ ID NO: 158 - protein, 298 aa, Blautia producta
MNKIGIYFAFWEKEWEADYCRYIEKAKKLGFDVLELAAGCLPDMTAAQRREIASRAEDAGIDLTYCIGLPPQYDLACEDASVRASGIRYVGELLKCIRQMGGDTLGGIIYSCWPGGTVTYDYKQKARERSLDSLRELSHMAEEYDINYCLEIVNRYEQYLLNTAAEGADFVRELDSPKVKLLLDCFHMNIEEDSFSEAIKTAGELLGHFHIGECNRKVPGRGHMDWDDMIRGLRDIDYSGKIVMEPFVRPGGQVGKDIKIYRDQSGNASEAQMDEMAEEALTFIREKLRSGGNQDGKN

SEQ ID NO: 159 - DNA, 807 bp, Artificial Sequence
  Synthetic
ggatccatgctgttaggtactcaagataaagatttttttccggaagatattttagagaaactagagtttgttaagtcaatgggattccagtccttcgagattgacggaaagttattagtagaaaatgtcgacaaagtaaaagaagccgtagaaaaaactggagtccctgtattaacggcttgtaatggttatcgtggttggatcggggatttcattgaagaacgcagactcaatggtgtggaagatttgaaagaaattttacgtgcggttaaaaaagtcgggggaactggcgtcgtcgtaccagcggcctggggtatgtttacgtttcgcctgccgccaatggtttcaccgcgcagtcatgagggtgatgtaaaagccattttagacagccttacagagttggaaaaagtcgcagaggaaacgggaacctatatttatcttgaaccgttaaaccgttaccaagaccacatgctaaatacgctggaagatgctgttggaatcattgataagggtggattcaaacgtgtgaaaattaccgcagacttttatcacatggcgattgaagaagatgatatcagtgagtctttacggaaatacaaagattatattggtcatattcatattgcggagaaccatcgttaccaaccgggaactggatctattgattgggcacgccacatgaaaacattaaaagaaattggatatgagggtccggtcgtaaacgagggtaggattcgtggagaggaccccctcaaagtctatcaagagagtgtagattttatgaaacagttcatgtgataacccggg

SEQ ID NO: 160 - protein, 263 aa, Blautia hydrogenotrophica DSM 10507
MLLGTQDKDFFPEDILEKLEFVKSMGFQSFEIDGKLLVENVDKVKEAVEKTGVPVLTACNGYRGWIGDFIEERRLNGVEDLKEILRAVKKVGGTGVVVPAAWGMFTFRLPPMVSPRSHEGDVKAILDSLTELEKVAEETGTYIYLEPLNRYQDHMLNTLEDAVGIIDKGGFKRVKITADFYHMAIEEDDISESLRKYKDYIGHIHIAENHRYQPGTGSIDWARHMKTLKEIGYEGPVVNEGRIRGEDPLKVYQESVDFMKQFM

SEQ ID NO: 161 - DNA, 888 bp, Artificial Sequence
  Synthetic
ggatccatgaagatgaaatttggaactttatacagttactggggaacaaaatggcaatgtgactatttgaaaacgttaaaacgcgtatctgatattggattcgatatcttagagatgggtgcaccacatttgttagaaatgtctgattatgaattatccgagctgcgtagagcggcgaaagatatggacatggtattaaccgccaatattggtccggcgaaagacaaagatctagcaagcccagacccggacattaggaaagctggagtgaattatctgattgacattttaaaagcgatggaaaaagtcgggtcgaagtccttggttggagcgatgtacagctactggccgtgtcaattcgagattaccgataaagaggccgcgtgggaacgctcaattgaaggaatgaaagaggtagccgaggccgctgaaagtttagggattgaatgttgccaggaagtcttaaaccgttatgagacttatattattacggattgtcgtgagggtttagagtattgtcgtcgtgttgggagtgaaaatgtcaacttactccttgatacgtttcacatgaacattgaagaagataatattcctgaggcaattcgcttagccggacgcaagctcggtcatctgcacgtcggagagagcaaccggaaattaccgggaatgggttcactaccgtggcgtgatatcggtcgtgcactgagagatattggatatgagaaaggtgtagtaatggaacccttccttttacagggtggcgaagttgcgcgcgattgtaaagtctggcgggatctaagtggaaatgcagatgagaaaatgttagaccgttatatcaaagaatctttaacttttctaaaacatgaatttaccttttgataacccggg

SEQ ID NO: 162 - protein, 290 aa, Ruminococcus torques ATCC 27756
MKMKFGTLYSYWGTKWQCDYLKTLKRVSDIGFDILEMGAPHLLEMSDYELSELRRAAKDMDMVLTANIGPAKDKDLASPDPDIRKAGVNYLIDILKAMEKVGSKSLVGAMYSYWPCQFEITDKEAAWERSIEGMKEVAEAAESLGIECCQEVLNRYETYIITDCREGLEYCRRVGSENVNLLLDTFHMNIEEDNIPEAIRLAGRKLGHLHVGESNRKLPGMGSLPWRDIGRALRDIGYEKGVVMEPFLLQGGEVARDCKVWRDLSGNADEKMLDRYIKESLTFLKHEFTF

SEQ ID NO: 163 - DNA, 912 bp, Artificial Sequence
  Synthetic
ggatccatgagatacggagtgcatttaggatgttggggaccggagtacgatgcagagcaattagcgttacatttagcgcaagccgcagagttaggtgcgcagacttttgagactagaattccagattccatcctggccggtgatgagcgtttttgtgaacaaattagacaagcgcaaaaagaaactggagtccaggctatttatacgttccgtttccccgaagggtatgaaatgtctgctccggaagaggaaccgcgtcagttagcgcaagactatctccgtctgagtattaggcgcattgcaaaggccggtggaacaatgttgggtggaattgtctattctcgctggccggcagattaccaaagcttgaggattgacccaaccgtaaaacgggaacgcttattacgtagtattgaagggatccggagtgttatgccgacggccgagtccgagggtgtaacggttaatctcgaagtcgtaaatcgctttgaacattatttaattaacactttggctgagggactagacttctgtcgctgtgtcgagagtccaaattgcaaattacttgcagatgtatttcacatgaatatcgaagaagatgacattccagcggcaattcgtgcagcaaaagggaaaattggtcacttccatgtatcagagcctaaccgtaaaattccgtatcataccgcccgtatttgttggccggaaattggaaaagcgttacgcgaaacgggatacgatggtagcgtcacgattgagtcttttttaatgtttctgggtgaggcgtcgcagaatatgcgtatttggcggaacctagagcaagatgtctcatttctaggtcgcatgcagcgtttacgtcagggattacattatattaaagattgttttgaaaacgatctttgataacccggg

SEQ ID NO: 164 - protein, 298 aa, Clostridium sp. MSTE9
MRYGVHLGCWGPEYDAEQLALHLAQAAELGAQTFETRIPDSILAGDERFCEQIRQAQKETGVQAIYTFRFPEGYEMSAPEEEPRQLAQDYLRLSIRRIAKAGGTMLGGIVYSRWPADYQSLRIDPTVKRERLLRSIEGIRSVMPTAESEGVTVNLEVVNRFEHYLINTLAEGLDFCRCVESPNCKLLADVFHMNIEEDDIPAAIRAAKGKIGHFHVSEPNRKIPYHTARICWPEIGKALRETGYDGSVTIESFLMFLGEASQNMRIWRNLEQDVSFLGRMQRLRQGLHYIKDCFENDL

SEQ ID NO: 165 - DNA, 870 bp, Arthrobacter globiformis
atgaaaattggttgccatggcctggtttggaccggccacttcgacgctgaaggcattcgctactccgtccagaaaaccagggaagccggtttcgacctcgttgagttcccgctcatggatccgttctccttcgatgtgcagacggccaagtccgcactggccgaacatgggctggcggcctcggcatctctgggactctcggacgccactgacgtaagcagcgaagatcccgccgtcgtgaaggcaggggaggagctgctcaaccgcgccgtggatgttctggccgaactgggtgcgacggatttctgcggcgtgatttatagcgccatgaagaagtacatggagccggcaactgctgccgggctggccaacagcaaggcagccgtcgggcgggtcgcggaccgggcatcggatctggggatcaatgtttcgctggaggtcgtcaacaggtacgaaaccaacgtactgaacaccggacgtcaggcccttgcctacttggaggagctcaaccggccgaacctgggcatccacctggacacttaccacatgaacattgaggaatcggacatgttctccccgatcctggacaccgcggaggccctgcggtacgtccatatcggcgaaagccaccgcggctacctcggcacgggaagcgttgacttcgacactttcttcaaggccctcggccgcatcggctatgacggacccgttgtcttcgaatcgttctcctcctccgtcgtggcaccggatctgagccggatgctcggcatctggcgcaacctgtgggccgacaacgaggaactgggtgcgcacgcgaatgccttcatccgcgacaagctcaccgcgatcaagaccatcgaactgcactaa

SEQ ID NO: 166 - protein, 288 aa, Arthrobacter globiformis
MKIGCHGLVWTGHFDAEGIRYSVQKTREAGFDLVEFPLMDPFSFDVQTAKSALAEHGLAASASLGLSDATDVSSEDPAVVKAGEELLNRAVDVLAELGATDFCGVIYSAMKKYMEPATAAGLANSKAAVGRVADRASDLGINVSLEVVNRYETNVLNTGRQALAYLEELNRPNLGIHLDTYHMNIEESDMFSPILDTAEALRYVHIGESHRGYLGTGSVDFDTFFKALGRIGYDGPVVFESFSSSVVAPDLSRMLGIWRNLWADNEELGAHANAFIRDKLTAIKTIEL

SEQ ID NO: 167 - DNA, 870 bp, Bulkholderia RP64
atgaacaaagtaggcatgttctatacatactggtcgactgaatggctcgtggattttccggctgtggcgaagcgcatctcgggtctgggtttcgacatgatggagatctcgctctccgagttccataacttgcctgatgcgaagaagcgcgaactcaagaccgtcgccgacgatctcggtttgacggtgatgtgctgcatcggtctcaagcctgagtacgatttcgcatcgccggaacagagcgtgcgcgatgcgggcacggaatacgtgaagcatctgctcgacgattgccacatgctcggcgcaccggttttcgcgggcctgacattctgcgcgtggccgcaatcgccgccgccaggcatgaaggacaagcgtccatacgtcgaacgcgcggtggacagcgtgcgccgtgtcatcaaggtcgctgaaggttacggcattatctacgcgctggaagtggtgaatcgcttcgagcaatggctcgccaacgatgcacgcgaggcgctcgcgttctgcgatgcagtcgataatccgtggtgcaaggtgcagctcgatacgttccacatgaacatcgaagagaactcgtttcgcgatgccattctcgcgtgccgcggccgtctcggacacttccatctcggcgaagcgaaccgcttgccgccgggcgaaggccgtctgccgtgggatgaaatcttcggcgcgttgaaagagatcgactacgacggcaccatcgtcatggagccgttcatgcgtcctggcggctcggtgagtcgtgccgtgggcgtctggcgcgacatgtcgaacggcgcgacggatgaacagatggacgaacgcgcacgccgttcattgaacttcgtgcgcggtcatctcgcg

SEQ ID NO: 168 - protein, 290 aa, Bulkholderia RP64; identical to SEQ ID NO: 138

SEQ ID NO: 169 - DNA, 885 bp, Desmospora sp.8437
catatgaaatacggtgtctactttgcttactgggaagattcgtgggatgttgactttgaaaaatacgttcgcaaggtgaaaaaactgggctttgatattctggaagttgcagcactgggtctggtcaacctgccggaagaaaaactggaacgtctgaagcagctggcggaacaacatgacattatcctgaccgccggcattggtctgccgaaagaatatgatgtcagctctacggacaaaaaagtgcgtcgcaatggcatctcctttatgaaaaaggttatggatgcaatgcatcaggctggtattcaccgtattggcggcaccgtgtatagctactggccggttgattacagttgctccttcgacaaaccggcggttcgcaagcactcaattgaatcggtccgtgaactggcggaatatgcccgccagtacaacattaccctgctgatcgaaacgctgaaccgctttgaacaattcctgctgaatgatgccgaagaagcggttgcctatgtcaaagaagtggatgaaccgaacgtcaaggtgatgctggacaccttccacatgaacatcgaagaagatcacatcgcagacgctatccgttacacgggcgatcatctgggtcagctgcacatcggcgaagccaaccgcaaagtgccgggcaagggtagtatgccgtggaccgaaattggccaagcactgaaagatatccgttatgacggttacgtggttatggaaccgttcattaaaaccggcggtcaggttggccgtgatatcaaactgtggcgcgacctgagcggtaatgcaacggaagaacaactggatcgcgaactggctgaatctctggaatttgtgaaagcagctttcggtgaataaagatctggatcc

SEQ ID NO: 170 - protein, 289 aa, Desmospora sp.8437
MKYGVYFAYWEDSWDVDFEKYVRKVKKLGFDILEVAALGLVNLPEEKLERLKQLAEQHDIILTAGIGLPKEYDVSSTDKKVRRNGISFMKKVMDAMHQAGIHRIGGTVYSYWPVDYSCSFDKPAVRKHSIESVRELAEYARQYNITLLIETLNRFEQFLLNDAEEAVAYVKEVDEPNVKVMLDTFHMNIEEDHIADAIRYTGDHLGQLHIGEANRKVPGKGSMPWTEIGQALKDIRYDGYVVMEPFIKTGGQVGRDIKLWRDLSGNATEEQLDRELAESLEFVKAAFGE

SEQ ID NO: 171 - DNA, 867 bp, Agrobacterium tumefaciens
atgaaacacggtatctactactcttactgggaacacgaatggtctgctaaattcggtccgtacatcgaaaaagttgctaaactgggtttcgacatcatcgaagttgctgctcaccacatcaacgaatactctgacgctgaactggctaccatccgtaaatctgctaaagacaacggtatcatcctgaccgctggtatcggtccgtctaaaaccaaaaacctgtcttctgaagacgctgctgttcgtgctgctggtaaagctttcttcgaacgtaccctgtctaacgttgctaaactggacatccacaccatcggtggtgctctgcactctacctggccgatcgactactctcagccggttgacaaagctggtgactacgctcgtggtgttgaaggtatcaacggtatcgctgacttcgctaacgacctgggtatcaacctgtgcatcgaagttctgaaccgtttcgaaaaccactacctgaacaccgctgctgaaggtgttgctttcgttaaagacgttggtaaaaacaacgttaaagttatgctggacaccttccacatgaacatcgaagaagactctttcggtgacgctatccgtaccgctggtccgctgctgggtcacttccacaccggtgaatctaaccgtcgtgttccgggtaaaggtcgtatgccgtggcacgaaatcggtctggctctgcgtgacatcaactacaccggtgctgttatcatggaaccgttcgttaaaaccggtggtaccatcggttctgacatcaaagtttggcgtgacctgtctggtggtgctgacatcgctaaaatggacgaagacgctcgtaacgctctggctttctctcgtttctacctgggtggt

SEQ ID NO: 172 - protein, 289 aa, Agrobacterium tumefaciens
MKHGIYYSYWEHEWSAKFGPYIEKVAKLGFDIIEVAAHHINEYSDAELATIRKSAKDNGIILTAGIGPSKTKNLSSEDAAVRAAGKAFFERTLSNVAKLDIHTIGGALHSTWPIDYSQPVDKAGDYARGVEGINGIADFANDLGINLCIEVLNRFENHYLNTAAEGVAFVKDVGKNNVKVMLDTFHMNIEEDSFGDAIRTAGPLLGHFHTGESNRRVPGKGRMPWHEIGLALRDINYTGAVIMEPFVKTGGTIGSDIKVWRDLSGGADIAKMDEDARNALAFSRFYLGG

SEQ ID NO: 173 - DNA, 867 bp, Agrobacterium tumefaciens
atgaaacacggtatctactactcttactgggaacacgaatggtctgctaaattcggtccgtacatcgaaaaagttgctaaactgggtttcgacatcctggaagttgctgctcaccacatcaacgaatactctgacgctgaactggctaccatccgtaaatctgctaaagacaacggtatcatcctgaccgctggtatcggtccgtctaaaaccaaaaacctgtcttctgaagacgctgctgttcgtgctgctggtaaagctttcttcgaacgtaccctgtctaacgttgctaaactggacatccacaccatcggtggtgctctgcactctacctggccgatcgactactctcagccggttgacaaagctggtgactacgctcgtggtgttgaaggtatcaacggtatcgctgacttcgctaacgacctgggtatcaacctgtgcatcgaagttctgaaccgtttcgaaaaccactacctgaacaccgctgctgaaggtgttgctttcgttaaagacgttggtaaaaacaacgttaaagttatgctggacaccttccacatgaacatcgaagaagactctttcggtgacgctatccgtaccgctggtccgctgctgggtcacttccacaccggtgaatgcaaccgtcgtgttccgggtaaaggtcgtatgccgtggcacgaaatcggtctggctctgcgtgacatcaactacaccggtgctgttatcatggaaccgttcgttaaaaccggtggtaccatcggttctgacatcaaagtttggcgtgacctgtctggtggtgctgacatcgctaaaatggacgaagacgctcgtaacgctctggctttctctcgtttctacctgggtggt

SEQ ID NO: 174 - protein, 289 aa, Agrobacterium tumefaciens
MKHGIYYSYWEHEWSAKFGPYIEKVAKLGFDILEVAAHHINEYSDAELATIRKSAKDNGIILTAGIGPSKTKNLSSEDAAVRAAGKAFFERTLSNVAKLDIHTIGGALHSTWPIDYSQPVDKAGDYARGVEGINGIADFANDLGINLCIEVLNRFENHYLNTAAEGVAFVKDVGKNNVKVMLDTFHMNIEEDSFGDAIRTAGPLLGHFHTGECNRRVPGKGRMPWHEIGLALRDINYTGAVIMEPFVKTGGTIGSDIKVWRDLSGGADIAKMDEDARNALAFSRFYLGG

SEQ ID NO: 175 - DNA, 870 bp, P. cichorii
atgaacaaagttggtatgttctacacctactggtctaccgaatggatggttgacttcccggctaccgctaaacgtatcgctggtctgggtttcgacctgatggaaatctctctgggtgaattccacaacctgtctgacgctaaaaaacgtgaactgaaagctgttgctgacgacctgggtctgaccgttatgtgctgcatcggtctgaaatctgaatacgacttcgcttctccggacaaatctgttcgtgacgctggtaccgaatacgttaaacgtctgctggacgactgccacctgctgggtgctccggttttcgctggtctgaccttctgcgcttggccgcagtctccgccgctggacatgaaagacaaacgtccgtacgttgaccgtgctatcgaatctgttcgtcgtgttatcaaagttgctgaagactacggtatcatctacgctctggaagttgttaaccgtttcgaacagtggctgtgcaacgacgctaaagaagctatcgctttcgctgacgctgttgactctccggcttgcaaagttcagctggacaccttccacatgaacatcgaagaaacctctttccgtgacgctatcctggcttgcaaaggtaaaatgggtcacttccacctgggtgaagctaaccgtctgccgccgggtgaaggtcgtctgccgtgggacgaaatcttcggtgctctgaaagaaatcggttacgacggtaccatcgttatggaaccgttcatgcgtaaaggtggttctgtttctcgtgctgttggtgtttggcgtgacatgtctaacggtgctaccgacgaagaaatggacgaacgtgctcgtcgttctctgcagttcgttcgtgacaaactggct

SEQ ID NO: 176 - protein, 290 aa, P. cichorii
MNKVGMFYTYWSTEWMVDFPATAKRIAGLGFDLMEISLGEFHNLSDAKKRELKAVADDLGLTVMCCIGLKSEYDFASPDKSVRDAGTEYVKRLLDDCHLLGAPVFAGLTFCAWPQSPPLDMKDKRPYVDRAIESVRRVIKVAEDYGIIYALEVVNRFEQWLCNDAKEAIAFADAVDSPACKVQLDTFHMNIEETSFRDAILACKGKMGHFHLGEANRLPPGEGRLPWDEIFGALKEIGYDGTIVMEPFMRKGGSVSRAVGVWRDMSNGATDEEMDERARRSLQFVRDKLA

SEQ ID NO: 177 - DNA, 879 bp, Clostridium cellulolyticum
atgaaacatggtatatactacgcatattgggaacaagaatgggaagctgattacaaatactatattgagaaggttgcaaagcttggttttgatattctagagattgcagcttcaccgctacctttttacagtgacattcagattaatgagctcaaggcatgtgcccatggcaatggaattacacttacggtaggccatgggcctagtgcagaacaaaacctgtcttctcccgaccccgatattcgcaaaaatgctaaagctttttataccgatttactcaaacgactttacaagctggatgtacatttgataggtggggctttatattcttattggccgatagattacacaaagacaattgataaaaaaggcgattgggaacgcagcgttgaaagtgttcgagaagttgctaaggtggccgaagcctgtggagtggatttctgcctagaggttcttaatagatttgagaattatttaattaacacagcacaagagggtgtagattttgtaaaacaggttgaccataacaatgtaaaggtaatgcttgataccttccacatgaatattgaggaagatagtatcggaggtgcaatcaggactgcgggctcttacttgggacatttacacactggcgaatgtaatcgtaaagttcccggcagaggaagaattccatgggtagaaattggtgaggctcttgctgacataggttataacggtagtgttgttatggaaccttttgttagaatgggcggaactgtcggatctaatattaaggtttggcgtgacattagtaacggtgcagatgagaaaatgctggatagagaagcacaggccgcacttgatttctccagatatgtattagaatgtcataaacactcc

SEQ ID NO: 178 - protein, 293 aa, Clostridium cellulolyticum; identical to SEQ ID NO: 154

SEQ ID NO: 179 - DNA, 879 bp, Clostridium cellulolyticum
atgaaacatggtatatactacgcatattgggaacaagaatgggaagctgattacaaatactatattgagaaggttgcaaagcttggttttgatattctagagattgcagcttcaccgctacctttttacagtgacattcagattaatgagctcaaggcatgtgcccatggcaatggaattacacttacggtaggccatgggcctagtgcagaacaaaacctgtcttctcccgaccccgatattcgcaaaaatgctaaagctttttataccgatttactcaaacgactttacaagctggatgtacatttgataggtggggctttatattcttattggccgatagattacacaaagacaattgataaaaaaggcgattgggaacgcagcgttgaaagtgttcgagaagttgctaaggtggccgaagcctgtggagtggatttctgcctagaggttcttaatagatttgagaattatttaattaacacagcacaagagggtgtagattttgtaaaacaggttgaccataacaatgtaaaggtaatgcttgataccttccacatgaatattgaggaagatagtatcggaggtgcaatcaggactgcgggctcttacttgggacatttacacactagcgaatgtaatcgtaaagttcccggcagaggaagaattccatgggtagaaattggtgaggctcttgctgacataggttataacggtagtgttgttatggaaccttttgttagaatgggcggaactgtcggatctaatattaaggtttggcgtgacattagtaacggtgcagatgagaaaatgctggatagagaagcacaggccgcacttgatttctccagatatgtattagaatgtcataaacactcc

SEQ ID NO: 180 - protein, 293 aa, Clostridium cellulolyticum
MKHGIYYAYWEQEWEADYKYYIEKVAKLGFDILEIAASPLPFYSDIQINELKACAHGNGITLTVGHGPSAEQNLSSPDPDIRKNAKAFYTDLLKRLYKLDVHLIGGALYSYWPIDYTKTIDKKGDWERSVESVREVAKVAEACGVDFCLEVLNRFENYLINTAQEGVDFVKQVDHNNVKVMLDTFHMNIEEDSIGGAIRTAGSYLGHLHTSECNRKVPGRGRIPWVEIGEALADIGYNGSVVMEPFVRMGGTVGSNIKVWRDISNGADEKMLDREAQAALDFSRYVLECHKHS

SEQ ID NO: 181 - DNA, 873 bp, Artificial Sequence
  Synthetic
atgaacaaagttggcatgttttatacgtattggagcactgagtggatggtcgattttccggccaccgcaaagcgtattgccggtctgggttttgacctgatggaaatcagcctgggtgagtttcacaacctcagcgacgccaagaaacgtgaactgaaagccgtggcggacgatctgggcctgacggtcatgtgctgtatcggtttgaagtctgagtacgatttcgctagcccggataagagcgtccgtgatgcgggtaccgaatacgtcaagcgcctgctggacgattgccatctgctgggtgcaccggtttttgcgggtctgacgttctgtgcgtggccgcagtccccgccactggacatgaaagacaagcgcccgtacgtggaccgtgcaatcgagagcgttcgtcgtgtgatcaaagtcgccgaggactatggcatcatttacgcactggaagttgtgaatcgcttcgagcagtggctgtgcaacgatgcgaaagaggcaattgcgttcgcggatgctgttgattctccggcgtgcaaagtgcaattggacaccttccacatgaatattgaggaaacctcctttcgcgatgcgatcctggcatgtaagggcaaaatgggccacttccatctgggtgaggcaaatcgtctgccgcctggcgagggtcgtctgccgtgggacgaaatctttggtgcgttgaaagaaattggctacgacggtaccattgttatggaaccgttcatgcgcaagggtggcagcgtttcgcgcgctgtgggcgtctggcgtgacatgagcaacggtgctaccgatgaagaaatggacgagcgtgcgcgtcgcagcctgcaattcgtgcgtgataaactggcgtga

SEQ ID NO: 182 - DNA, 873 bp, Artificial Sequence
  Synthetic
atgaataaagtcggaatgttttacacttattggtcaacggaatggatggtcgatttcccagcaactgctaaacgtatcgcgggactcggattcgatttgatggaaattagcctcggagagttccataatctaagtgacgccaagaaacgtgagctgaaagctgtcgcagacgatcttggtttaaccgttatgtgttgtattgggttgaaaagtgagtatgatttcgcgtcaccggataaatctgtacgggatgcgggaacggaatatgtgaaacgtttattggatgattgccatttactaggggcgcccgtttttgcgggactgactttttgtgcatggccgcaatcccctccactagacatgaaagacaaacgcccctatgtcgatcgtgcaattgaatcggtacggcgcgtaattaaagtcgcggaagattacggtattatctacgccttagaagtcgtgaacagatttgagcaatggttatgtaatgatgcaaaagaggccattgcgtttgccgacgccgtagatagcccggcatgtaaagttcaattagatacatttcacatgaatattgaagagacttcctttcgcgacgccattcttgcgtgtaagggaaaaatgggtcacttccatctgggagaggcaaaccgtttaccgccgggtgagggccgtttaccgtgggacgaaatttttggtgcattaaaagaaattggttatgatggaacgattgtaatggaaccatttatgcgtaaaggtgggtctgtcagcagagccgtcggtgtatggcgtgatatgagtaacggtgctaccgatgaagaaatggacgagcgcgctaggcgcagtttacagttcgtacgtgacaaattagcgtga

SEQ ID NO: 183 - DNA, 858 bp, Artificial Sequence
  Synthetic
  misc_feature (6)..(6): n is a, c, g, or t
  misc_feature (12)..(12): n is a, c, g, or t
  misc_feature (18)..(18): n is a, c, g, or t
  misc_feature (27)..(27): n is a, c, g, or t
  misc_feature (30)..(30): n is a, c, g, or t
  misc_feature (33)..(33): n is a, c, g, or t
  misc_feature (39)..(39): n is a, c, g, or t
  misc_feature (42)..(42): n is a, c, g, or t
  misc_feature (45)..(45): n is a, c, g, or t
  misc_feature (51)..(51): n is a, c, g, or t
  misc_feature (54)..(54): n is a, c, g, or t
  misc_feature (63)..(63): n is a, c, g, or t
  misc_feature (66)..(66): n is a, c, g, or t
  misc_feature (72)..(72): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (87)..(87): n is a, c, g, or t
  misc_feature (93)..(93): n is a, c, g, or t
  misc_feature (96)..(96): n is a, c, g, or t
  misc_feature (105)..(105): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (123)..(123): n is a, c, g, or t
  misc_feature (129)..(129): n is a, c, g, or t
  misc_feature (135)..(135): n is a, c, g, or t
  misc_feature (138)..(138): n is a, c, g, or t
  misc_feature (144)..(144): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (216)..(216): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (237)..(237): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (270)..(270): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (324)..(324): n is a, c, g, or t
  misc_feature (330)..(330): n is a, c, g, or t
  misc_feature (336)..(336): n is a, c, g, or t
  misc_feature (339)..(339): n is a, c, g, or t
  misc_feature (342)..(342): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (381)..(381): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (405)..(405): n is a, c, g, or t
  misc_feature (411)..(411): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (456)..(456): n is a, c, g, or t
  misc_feature (465)..(465): n is a, c, g, or t
  misc_feature (471)..(471): n is a, c, g, or t
  misc_feature (474)..(474): n is a, c, g, or t
  misc_feature (480)..(480): n is a, c, g, or t
  misc_feature (483)..(483): n is a, c, g, or t
  misc_feature (486)..(486): n is a, c, g, or t
  misc_feature (492)..(492): n is a, c, g, or t
  misc_feature (495)..(495): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (528)..(528): n is a, c, g, or t
  misc_feature (531)..(531): n is a, c, g, or t
  misc_feature (534)..(534): n is a, c, g, or t
  misc_feature (540)..(540): n is a, c, g, or t
  misc_feature (546)..(546): n is a, c, g, or t
  misc_feature (570)..(570): n is a, c, g, or t
  misc_feature (573)..(573): n is a, c, g, or t
  misc_feature (579)..(579): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (615)..(615): n is a, c, g, or t
  misc_feature (618)..(618): n is a, c, g, or t
  misc_feature (624)..(624): n is a, c, g, or t
  misc_feature (630)..(630): n is a, c, g, or t
  misc_feature (633)..(633): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (663)..(663): n is a, c, g, or t
  misc_feature (666)..(666): n is a, c, g, or t
  misc_feature (669)..(669): n is a, c, g, or t
  misc_feature (672)..(672): n is a, c, g, or t
  misc_feature (678)..(678): n is a, c, g, or t
  misc_feature (690)..(690): n is a, c, g, or t
  misc_feature (693)..(693): n is a, c, g, or t
  misc_feature (696)..(696): n is a, c, g, or t
  misc_feature (699)..(699): n is a, c, g, or t
  misc_feature (705)..(705): n is a, c, g, or t
  misc_feature (714)..(714): n is a, c, g, or t
  misc_feature (717)..(717): n is a, c, g, or t
  misc_feature (720)..(720): n is a, c, g, or t
  misc_feature (726)..(726): n is a, c, g, or t
  misc_feature (735)..(735): n is a, c, g, or t
  misc_feature (741)..(741): n is a, c, g, or t
  misc_feature (744)..(744): n is a, c, g, or t
  misc_feature (750)..(750): n is a, c, g, or t
  misc_feature (753)..(753): n is a, c, g, or t
  misc_feature (759)..(759): n is a, c, g, or t
  misc_feature (762)..(762): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (777)..(777): n is a, c, g, or t
  misc_feature (789)..(789): n is a, c, g, or t
  misc_feature (795)..(795): n is a, c, g, or t
  misc_feature (801)..(801): n is a, c, g, or t
  misc_feature (807)..(807): n is a, c, g, or t
  misc_feature (813)..(813): n is a, c, g, or t
  misc_feature (816)..(816): n is a, c, g, or t
  misc_feature (819)..(819): n is a, c, g, or t
  misc_feature (822)..(822): n is a, c, g, or t
  misc_feature (828)..(828): n is a, c, g, or t
  misc_feature (831)..(831): n is a, c, g, or t
  misc_feature (840)..(840): n is a, c, g, or t
  misc_feature (843)..(843): n is a, c, g, or t
  misc_feature (852)..(852): n is a, c, g, or t
  misc_feature (858)..(858): n is a, c, g, or t
atgacnaayccnathggnathcaygcnytngtntgggcnggnggntggwsnmgngaycargcnmgncaygcnathgcnwsnwsngcngargcnggntaygayytnathgarytnwsngcnytngarccngayacngtngaygcngcnggnacngcngcnytnytngcngartayggnytngcngcnwsngtnwsnytnggnytngaygarwsnacngaygtnwsnwsngargayccngarathgtngcngcnggnmgnmgnmgnytnacngcngcngtngayytngtnmgngayathggnggnaaytayytnggnggngtnytnttywsnaarytnggnmgntayacnacnccnccnacngarmgnggnmgngcncaygcnmgngargcnytngcnacnytngcngaymgngcngcngcnwsngayathacnytnggnytngarttytgyaaymgntaygaracnaayytnytnaayacnacngcncaracnytngayttyathgcngarytnggnmgngayaaygtngtngcncayytngayacntaycayatgaayathgargaracnwsnttymgngarccngtnytngcngcngcngcngcnggnaarytnggntaygtncaygtnggngarwsncaymgnggngcnytnggnacnggnwsngtnccntgggcngarttyttyacngcnytnmgngaygtngaytayacnggnacnathacnttygarwsnttywsnwsngargtngtncayccnwsnytnwsnwsnaayytntgyathtggmgngayccntggacngayggnatgmgnytngcnmgngaygcnmgncarttyytnmgngayaayytngaygtn

SEQ ID NO: 184 - protein, 286 aa, Amycolatopsis taiwanensis
MTNPIGIHALVWAGGWSRDQARHAIASSAEAGYDLIELSALEPDTVDAAGTAALLAEYGLAASVSLGLDESTDVSSEDPEIVAAGRRRLTAAVDLVRDIGGNYLGGVLFSKLGRYTTPPTERGRAHAREALATLADRAAASDITLGLEFCNRYETNLLNTTAQTLDFIAELGRDNVVAHLDTYHMNIEETSFREPVLAAAAAGKLGYVHVGESHRGALGTGSVPWAEFFTALRDVDYTGTITFESFSSEVVHPSLSSNLCIWRDPWTDGMRLARDARQFLRDNLDV

SEQ ID NO: 185 - DNA, 879 bp, Artificial Sequence
  Synthetic
ggatccatgagcaataaaattggaattcatgcattagtttgggttgggggttggagcgaacgtgaggcgcgtcacgctatttctagttcagccgcggcgggatatgacttaattgaattagcggcgattcagccagagttgtttgatgccgatttaacagccagattactagccgagcatggtttatctgccggagtgtcactgggattagatgataccactgatgtatcgtccgatgacccagacatcgtagcagcgggacggaaacggttagatttagcactagatctcgtacgcgatgttggtggagactatttggggggagtcatttttggcaaactcggacgctacacgactccgcttactgagcgtggtagagctcatagcgtagagactattgccaggttggcagatcgcgcagcagagtctggaattactttagggttagaattttgtaatcgttatgaaacgaatgtactgaataccaccgagcaaacattagcctttatcgcagaaacgggtagggacaatgtagtagcgcatcttgacacctatcacatgaacattgaagagactagcttccgtgaaccggtcctggcagcggcggccgctggaaaacttggttatgtccatgttggtgagtcacaccgtggtcagctaggaacgggatccgtcccgtgggcggaattcttcgaggccttacatgaagtcgattaccgcggtacgattacttttgaatcttttagtagtgaagtcgtccatcccactttatcatccgcgctaagtatttggcgcaacttgtggactgatggtatggacttagctacgggagcgcgtgcatttctgaagcaaaactacgaaacccgttgataacccggg

SEQ ID NO: 186 - protein, 287 aa, Pseudonocardia spinosispora
MSNKIGIHALVWVGGWSEREARHAISSSAAAGYDLIELAAIQPELFDADLTARLLAEHGLSAGVSLGLDDTTDVSSDDPDIVAAGRKRLDLALDLVRDVGGDYLGGVIFGKLGRYTTPLTERGRAHSVETIARLADRAAESGITLGLEFCNRYETNVLNTTEQTLAFIAETGRDNVVAHLDTYHMNIEETSFREPVLAAAAAGKLGYVHVGESHRGQLGTGSVPWAEFFEALHEVDYRGTITFESFSSEVVHPTLSSALSIWRNLWTDGMDLATGARAFLKQNYETR

SEQ ID NO: 187 - DNA, 885 bp, Artificial Sequence
  Synthetic
  misc_feature (6)..(6): n is a, c, g, or t
  misc_feature (9)..(9): n is a, c, g, or t
  misc_feature (12)..(12): n is a, c, g, or t
  misc_feature (18)..(18): n is a, c, g, or t
  misc_feature (21)..(21): n is a, c, g, or t
  misc_feature (27)..(27): n is a, c, g, or t
  misc_feature (30)..(30): n is a, c, g, or t
  misc_feature (33)..(33): n is a, c, g, or t
  misc_feature (39)..(39): n is a, c, g, or t
  misc_feature (42)..(42): n is a, c, g, or t
  misc_feature (45)..(45): n is a, c, g, or t
  misc_feature (51)..(51): n is a, c, g, or t
  misc_feature (54)..(54): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (87)..(87): n is a, c, g, or t
  misc_feature (93)..(93): n is a, c, g, or t
  misc_feature (96)..(96): n is a, c, g, or t
  misc_feature (105)..(105): n is a, c, g, or t
  misc_feature (117)..(117): n is a, c, g, or t
  misc_feature (120)..(120): n is a, c, g, or t
  misc_feature (129)..(129): n is a, c, g, or t
  misc_feature (132)..(132): n is a, c, g, or t
  misc_feature (135)..(135): n is a, c, g, or t
  misc_feature (144)..(144): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (165)..(165): n is a, c, g, or t
  misc_feature (177)..(177): n is a, c, g, or t
  misc_feature (180)..(180): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (210)..(210): n is a, c, g, or t
  misc_feature (216)..(216): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (237)..(237): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (264)..(264): n is a, c, g, or t
  misc_feature (267)..(267): n is a, c, g, or t
  misc_feature (270)..(270): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (306)..(306): n is a, c, g, or t
  misc_feature (309)..(309): n is a, c, g, or t
  misc_feature (312)..(312): n is a, c, g, or t
  misc_feature (318)..(318): n is a, c, g, or t
  misc_feature (321)..(321): n is a, c, g, or t
  misc_feature (324)..(324): n is a, c, g, or t
  misc_feature (330)..(330): n is a, c, g, or t
  misc_feature (336)..(336): n is a, c, g, or t
  misc_feature (339)..(339): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (381)..(381): n is a, c, g, or t
  misc_feature (390)..(390): n is a, c, g, or t
  misc_feature (396)..(396): n is a, c, g, or t
  misc_feature (402)..(402): n is a, c, g, or t
  misc_feature (405)..(405): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (456)..(456): n is a, c, g, or t
  misc_feature (465)..(465): n is a, c, g, or t
  misc_feature (471)..(471): n is a, c, g, or t
  misc_feature (474)..(474): n is a, c, g, or t
  misc_feature (480)..(480): n is a, c, g, or t
  misc_feature (483)..(483): n is a, c, g, or t
  misc_feature (492)..(492): n is a, c, g, or t
  misc_feature (495)..(495): n is a, c, g, or t
  misc_feature (507)..(507): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (522)..(522): n is a, c, g, or t
  misc_feature (528)..(528): n is a, c, g, or t
  misc_feature (534)..(534): n is a, c, g, or t
  misc_feature (540)..(540): n is a, c, g, or t
  misc_feature (546)..(546): n is a, c, g, or t
  misc_feature (573)..(573): n is a, c, g, or t
  misc_feature (579)..(579): n is a, c, g, or t
  misc_feature (585)..(585): n is a, c, g, or t
  misc_feature (588)..(588): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (609)..(609): n is a, c, g, or t
  misc_feature (612)..(612): n is a, c, g, or t
  misc_feature (615)..(615): n is a, c, g, or t
  misc_feature (618)..(618): n is a, c, g, or t
  misc_feature (624)..(624): n is a, c, g, or t
  misc_feature (630)..(630): n is a, c, g, or t
  misc_feature (633)..(633): n is a, c, g, or t
  misc_feature (639)..(639): n is a, c, g, or t
  misc_feature (645)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (663)..(663): n is a, c, g, or t
  misc_feature (666)..(666): n is a, c, g, or t
  misc_feature (672)..(672): n is a, c, g, or t
  misc_feature (678)..(678): n is a, c, g, or t
  misc_feature (690)..(690): n is a, c, g, or t
  misc_feature (693)..(693): n is a, c, g, or t
  misc_feature (696)..(696): n is a, c, g, or t
  misc_feature (705)..(705): n is a, c, g, or t
  misc_feature (708)..(708): n is a, c, g, or t
  misc_feature (717)..(717): n is a, c, g, or t
  misc_feature (723)..(723): n is a, c, g, or t
  misc_feature (726)..(726): n is a, c, g, or t
  misc_feature (735)..(735): n is a, c, g, or t
  misc_feature (741)..(741): n is a, c, g, or t
  misc_feature (744)..(744): n is a, c, g, or t
  misc_feature (750)..(750): n is a, c, g, or t
  misc_feature (753)..(753): n is a, c, g, or t
  misc_feature (759)..(759): n is a, c, g, or t
  misc_feature (762)..(762): n is a, c, g, or t
  misc_feature (765)..(765): n is a, c, g, or t
  misc_feature (768)..(768): n is a, c, g, or t
  misc_feature (777)..(777): n is a, c, g, or t
  misc_feature (780)..(780): n is a, c, g, or t
  misc_feature (789)..(789): n is a, c, g, or t
  misc_feature (795)..(795): n is a, c, g, or t
  misc_feature (801)..(801): n is a, c, g, or t
  misc_feature (813)..(813): n is a, c, g, or t
  misc_feature (816)..(816): n is a, c, g, or t
  misc_feature (819)..(819): n is a, c, g, or t
  misc_feature (822)..(822): n is a, c, g, or t
  misc_feature (828)..(828): n is a, c, g, or t
  misc_feature (831)..(831): n is a, c, g, or t
  misc_feature (834)..(834): n is a, c, g, or t
  misc_feature (840)..(840): n is a, c, g, or t
  misc_feature (846)..(846): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (858)..(858): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (870)..(870): n is a, c, g, or t
  misc_feature (873)..(873): n is a, c, g, or t
  misc_feature (876)..(876): n is a, c, g, or t
  misc_feature (879)..(879): n is a, c, g, or t
  misc_feature (882)..(882): n is a, c, g, or t
  misc_feature (885)..(885): n is a, c, g, or t
atgccngtnacncayggngtncaygcnytngtntggacnggnggntggwsnccngargargcnmgnmgngcngtngcngcnwsngcngargcnggntaygayytnathgarathgcnccnathgayccnacnggntaygaygcngayytnacngcnmgnytnytncargarcayggnytncargtnwsngcnwsnytnggnytnggngcngayacngaygtnwsnwsngargayccngayacngtngcnmgnggnmgngarmgnytngcnacngcnytnggngtnytnmgngaywsnggnggnacnacnytntgyggngtnytntaywsnaarytnggnaartaygaygcnccngcnacngarmgnggnmgngcnaaywsncargargcnathgcntggytngcngayaargcngcngcnwsnggnathacnytngcnytngarttytgyaaymgntaygaracnaaygtnytnaayacnacncarcaracnytngayttyathgcngcngtngaymgnccnaaygtnatggcncayytngayacntaycayatgaayathgargarcaywsnttyacngargcngtnmgngcngcngcngcngcnggnmgnytnggntaygtncaygtnggngarwsncaymgnggngcnytnggnacnggnwsnathccntgggcngarttyttyggngcnytngaygargtnggntaygayggnathgtnacnttygarwsnttywsnwsngargtngtncaymgnacnytnwsnaaygayytngcnathtggmgnaayytntggacngayaaycaygcnytngcnmgngaygcnytngcnttyacnaargcnggnytngcnggngcngcngcnmgnmgnggngcnccnggn

SEQ ID NO: 188 - protein, 295 aa, Modestobacter sp. KNN45-2b
MPVTHGVHALVWTGGWSPEEARRAVAASAEAGYDLIEIAPIDPTGYDADLTARLLQEHGLQVSASLGLGADTDVSSEDPDTVARGRERLATALGVLRDSGGTTLCGVLYSKLGKYDAPATERGRANSQEAIAWLADKAAASGITLALEFCNRYETNVLNTTQQTLDFIAAVDRPNVMAHLDTYHMNIEEHSFTEAVRAAAAAGRLGYVHVGESHRGALGTGSIPWAEFFGALDEVGYDGIVTFESFSSEVVHRTLSNDLAIWRNLWTDNHALARDALAFTKAGLAGAAARRGAPG

SEQ ID NO: 189 - DNA, 909 bp, Artificial Sequence
  Synthetic
ggatccatgtcaagaattggaattcatagtttcgtatggtctgcaagcagcgcacagggtgagttagaacggactctcgcgaatacgcgtgaggccggatttgagttaattgaatttagttatctagatccggcagacgtcgatattggtggattagcgaaacgcattgcggatctgggattaggggtcgcgatttctattggattaccagcggacggtgacattagttccgcggataaagccgtagcggctcgcggtgtagagatcttgaaccagaccattgcattaactcgggatttgggtggacgcaaagtcgcaggcattctaagtactagccatggattacaagttgaagccccgacgagagatcaatggaaccgttcggccgcggccctggccaaagtcgctgagacagcaaaagctgcgggagtcaccttaaacttagaaattgtcaatcgctttgagagtaatctactaaacactgctgcgcaaggtttagccttcattgaagataccgggtccgacaatattttcttacatttagatacgtttcacatgaacattgaagaggctgacgtgggtcttgcaattcgtcacgcggcggctaagattggatacgtacatattggagaatctcaccgtggatttttgggtactggtaatatcgactttgcagcaatctttgatgcacttacagcaattggttatgccgatgacttaagtttcgaaagcttttcctcagagattgttgatgagaatctctcaaagaaaacggcaatttggcgtaatttatggactgataacatggcgttagcgaaacatgcaagggccttcatcggattagggttagaaacggcccgtcgtaaagccgaactggtttctgcgcgccataaaccctgataacccggg

SEQ ID NO: 190 - protein, 297 aa, Mesorhizobium sp. LNHC221B00
MSRIGIHSFVWSASSAQGELERTLANTREAGFELIEFSYLDPADVDIGGLAKRIADLGLGVAISIGLPADGDISSADKAVAARGVEILNQTIALTRDLGGRKVAGILSTSHGLQVEAPTRDQWNRSAAALAKVAETAKAAGVTLNLEIVNRFESNLLNTAAQGLAFIEDTGSDNIFLHLDTFHMNIEEADVGLAIRHAAAKIGYVHIGESHRGFLGTGNIDFAAIFDALTAIGYADDLSFESFSSEIVDENLSKKTAIWRNLWTDNMALAKHARAFIGLGLETARRKAELVSARHKP

The invention claimed is:

1. A method of producing allulose comprising:
   contacting a solution containing fructose with an enzyme having epimerase activity, the enzyme having a sequence selected from the group consisting of SEQ ID NO: 20, SEQ ID NO: 18, SEQ ID NO: 16, and SEQ ID NO: 14 for a time and under conditions suitable to convert at least a portion of the fructose to allulose;
   wherein when placed in contact with fructose at a temperature of 50° C. for 2 hours at a pH of 6, the enzyme converts the fructose to the allulose.

2. The method of claim 1 wherein said enzyme is obtained from a microorganism containing a recombinant nucleic acid vector operably configured with a promoter to express a nucleic acid sequence encoding the enzyme, wherein said promoter is non-native to the nucleic acid encoding said enzyme.

3. The method of claim 2 wherein said microorganism is selected from the group consisting of *Bacillus licheniformis, Saccharomyces cerevisiae, Schizosaccharomyces ombe, Pseudomonas putida, Pichia* sp. *Aspergillus* sp., *Trichoderma reesei, Corynebacterium glutamicum, E. coli* and *B. subtilis*.

4. The method of claim 3 wherein said microorganism is selected from the group consisting of *E. coli* and *B. subtilis*.

* * * * *